(12) United States Patent
Thompson et al.

(10) Patent No.: US 9,493,564 B2
(45) Date of Patent: Nov. 15, 2016

(54) CD86 ANTAGONIST MULTI-TARGET BINDING PROTEINS

(75) Inventors: Peter Armstrong Thompson, Bellevue, WA (US); Peter Robert Baum, Seattle, WA (US); Philip Tan, Edmonds, WA (US); John W. Blankenship, Seattle, WA (US); Sateesh Kumar Natarajan, Redmond, WA (US)

(73) Assignee: APTEVO RESEARCH AND DEVELOPMENT LLC, Seattle, WA (US)

( * ) Notice: Subject to any disclaimer, the term of this patent is extended or adjusted under 35 U.S.C. 154(b) by 301 days.

(21) Appl. No.: 13/122,383

(22) PCT Filed: Oct. 2, 2009

(86) PCT No.: PCT/US2009/059446
§ 371 (c)(1),
(2), (4) Date: May 19, 2011

(87) PCT Pub. No.: WO2010/040105
PCT Pub. Date: Apr. 8, 2010

(65) Prior Publication Data
US 2012/0100139 A1 Apr. 26, 2012

Related U.S. Application Data

(60) Provisional application No. 61/102,288, filed on Oct. 2, 2008, provisional application No. 61/102,297, filed on Oct. 2, 2008, provisional application No. 61/102,307, filed on Oct. 2, 2008, provisional application No. 61/102,315, filed on Oct. 2, 2008, provisional application No. 61/102,319, filed on Oct. 2, 2008, provisional application No. 61/102,327, filed on Oct. 2, 2008, provisional application No. 61/102,331, filed on Oct. 2, 2008, provisional application No. 61/102,334, filed on Oct. 2, 2008, provisional application No. 61/102,336, filed on Oct. 2, 2008.

(51) Int. Cl.
*A61K 39/00* (2006.01)
*C07K 16/28* (2006.01)
*A61K 39/395* (2006.01)

(52) U.S. Cl.
CPC .......... *C07K 16/2827* (2013.01); *A61K 39/00* (2013.01); *A61K 39/39558* (2013.01); *A61K 2039/505* (2013.01); *C07K 2317/24* (2013.01); *C07K 2317/622* (2013.01)

(58) Field of Classification Search
CPC .................... A61K 39/00; A61K 2039/505
USPC .............................. 530/350, 387.1
See application file for complete search history.

(56) References Cited

U.S. PATENT DOCUMENTS

| | | |
|---|---|---|
| 5,837,293 A | 11/1998 | De Waal Malefyt |
| 5,874,082 A | 2/1999 | de Boer |
| 6,090,914 A | 7/2000 | Linsley et al. |
| 6,132,992 A | 10/2000 | Ledbetter et al. |
| 6,428,985 B1 | 8/2002 | Bromberg et al. |
| 6,482,919 B2 | 11/2002 | Ledbetter et al. |
| 6,613,327 B1 | 9/2003 | Ling et al. |
| 6,699,972 B1 | 3/2004 | Roffler et al. |
| 6,809,185 B1 | 10/2004 | Schoonjans et al. |
| 6,824,779 B1 | 11/2004 | Freeman et al. |
| 6,838,261 B1 | 1/2005 | Siegall et al. |
| 6,972,125 B2 | 12/2005 | Co et al. |
| 7,405,288 B2 | 7/2008 | Galanis et al. |
| 7,439,230 B2 | 10/2008 | Peach et al. |
| 7,459,544 B2 | 12/2008 | Freeman et al. |
| 7,521,051 B2 | 4/2009 | Collins et al. |
| 7,572,772 B2 | 8/2009 | Linsley et al. |
| 7,579,316 B2 | 8/2009 | Khare et al. |
| 7,612,181 B2 | 11/2009 | Wu et al. |
| 7,671,022 B2 | 3/2010 | Rusnak |
| 7,723,482 B2 | 5/2010 | Soulillou et al. |
| 7,754,208 B2 | 7/2010 | Ledbetter et al. |
| 7,754,209 B2 | 7/2010 | Ledbetter et al. |
| 7,794,718 B2 | 9/2010 | Karrer et al. |
| 7,829,084 B2 | 11/2010 | Ledbetter et al. |
| 7,829,534 B2 | 11/2010 | Larsen et al. |
| 7,915,395 B2 | 3/2011 | Ledbetter et al. |

(Continued)

FOREIGN PATENT DOCUMENTS

| | | |
|---|---|---|
| WO | WO 93/00431 A1 | 1/1993 |
| WO | WO 95/01994 A1 | 1/1995 |

(Continued)

OTHER PUBLICATIONS

Jiang et al. (J. Biol. Chem. Feb. 11, 2005; 280 (6): 4656-4662).*

(Continued)

*Primary Examiner* — Stephen Rawlings
(74) *Attorney, Agent, or Firm* — Cooley LLP

(57) ABSTRACT

This disclosure provides a multi-specific fusion protein composed of a CD86 antagonist binding domain and another binding domain that is an IL-10 agonist, an HLA-G agonist, an HGF agonist, an IL-35 agonist, a PD-1 agonist, a BTLA agonist, a LIGHT antagonist, a GITRL antagonist or a CD40 antagonist. The multi-specific fusion protein may also include an intervening domain that separates the other domains. This disclosure also provides polynucleotides encoding the multi-specific fusion proteins, compositions of the fusion proteins, and methods of using the multi-specific fusion proteins and compositions.

33 Claims, 24 Drawing Sheets

(56) References Cited

U.S. PATENT DOCUMENTS

| | | | |
|---|---|---|---|
| 7,951,918 | B2 | 5/2011 | Glaser et al. |
| 8,071,095 | B2 | 12/2011 | Karrer et al. |
| 8,088,736 | B2 | 1/2012 | Franks et al. |
| 8,106,161 | B2 | 1/2012 | Ledbetter et al. |
| 8,147,835 | B2 | 4/2012 | Ledbetter et al. |
| 8,188,237 | B2 | 5/2012 | Ledbetter et al. |
| 8,197,810 | B2 | 6/2012 | Ledbetter et al. |
| 2002/0071839 | A1 | 6/2002 | Collins et al. |
| 2002/0150559 | A1* | 10/2002 | DeBoer et al. ............ 424/93.6 |
| 2003/0035816 | A1 | 2/2003 | Peach et al. |
| 2003/0133939 | A1 | 7/2003 | Ledbetter et al. |
| 2003/0232051 | A1 | 12/2003 | Long et al. |
| 2004/0014171 | A1 | 1/2004 | Peach et al. |
| 2004/0058445 | A1 | 3/2004 | Ledbetter et al. |
| 2005/0014224 | A1 | 1/2005 | Collins et al. |
| 2005/0043516 | A1 | 2/2005 | Chuntharapai et al. |
| 2005/0118164 | A1 | 6/2005 | Herman |
| 2005/0175614 | A1 | 8/2005 | Ledbetter et al. |
| 2005/0180970 | A1 | 8/2005 | Ledbetter et al. |
| 2005/0186216 | A1 | 8/2005 | Ledbetter et al. |
| 2005/0196402 | A1 | 9/2005 | Gray et al. |
| 2005/0202012 | A1 | 9/2005 | Ledbetter et al. |
| 2005/0202023 | A1 | 9/2005 | Ledbetter et al. |
| 2005/0202534 | A1 | 9/2005 | Ledbetter et al. |
| 2005/0238646 | A1 | 10/2005 | Ledbetter et al. |
| 2005/0261478 | A1 | 11/2005 | Ledbetter et al. |
| 2007/0014794 | A1 | 1/2007 | Carter et al. |
| 2007/0110742 | A1 | 5/2007 | Chae et al. |
| 2007/0122378 | A1 | 5/2007 | Freeman et al. |
| 2007/0218062 | A1 | 9/2007 | Irving |
| 2008/0057070 | A1 | 3/2008 | Long et al. |
| 2009/0148447 | A1 | 6/2009 | Ledbetter et al. |
| 2009/0175867 | A1 | 7/2009 | Thompson et al. |
| 2009/0196870 | A1 | 8/2009 | Ledbetter et al. |
| 2010/0203052 | A1 | 8/2010 | Ledbetter et al. |
| 2010/0279932 | A1 | 11/2010 | Ledbetter et al. |
| 2011/0033483 | A1 | 2/2011 | Ledbetter et al. |
| 2011/0223164 | A1 | 9/2011 | Ledbetter et al. |
| 2012/0034245 | A9 | 2/2012 | Ledbetter et al. |
| 2012/0052065 | A1 | 3/2012 | Peach et al. |
| 2012/0213773 | A1 | 8/2012 | Ledbetter et al. |

FOREIGN PATENT DOCUMENTS

| | | |
|---|---|---|
| WO | WO 95/03411 A1 | 2/1995 |
| WO | WO 98/03670 | 1/1998 |
| WO | WO 98/31820 A1 | 7/1998 |
| WO | WO 98/58965 A2 | 12/1998 |
| WO | WO 00/06605 A2 | 2/2000 |
| WO | WO 01/88159 A2 | 11/2001 |
| WO | WO 01/92337 A2 | 12/2001 |
| WO | WO 02/02781 A1 | 1/2002 |
| WO | WO 02/056910 A1 | 7/2002 |
| WO | WO 2004/076488 | 9/2004 |
| WO | WO 2005/017148 A1 | 2/2005 |
| WO | WO 2006/048749 A1 | 5/2006 |
| WO | WO 2006/063067 A2 | 6/2006 |
| WO | WO 2006/138670 A3 | 12/2006 |
| WO | WO 2007/048037 A2 | 4/2007 |
| WO | WO 2007/109254 A3 | 9/2007 |
| WO | WO 2007/146968 A2 | 12/2007 |
| WO | WO 2008/071447 A2 | 6/2008 |
| WO | WO 2009/023386 A2 | 2/2009 |
| WO | WO 2009/080251 A1 | 7/2009 |
| WO | WO 2009/080254 A1 | 7/2009 |
| WO | WO 2010/014629 A1 | 2/2010 |
| WO | WO 2010/034441 A1 | 4/2010 |
| WO | WO 2010/040508 A1 | 4/2010 |
| WO | WO 2010/042904 A2 | 4/2010 |
| WO | WO 2010/136172 A1 | 12/2010 |
| WO | WO 2011/079308 A2 | 6/2011 |
| WO | WO 2011/090754 A1 | 7/2011 |
| WO | WO 2011/090761 A1 | 7/2011 |
| WO | WO 2011/090762 A1 | 7/2011 |
| WO | WO 2012/045334 A1 | 4/2012 |

OTHER PUBLICATIONS

Skolnick et al. (Trends in Biotechnology 2000; 18: 34-39).*
Bowie et al. (Science 1990; 257: 1306-1310).*
Burgess et al. (Journal of Cell Biology 1990; 111: 2129-2138).*
Lazar et al. (Molecular and Cellular Biology, 1988, 8: 1247-1252).*
Agematsu, K., et al., "Generation of Plasma Cells From Peripheral Blood Memory B Cells: Synergistic Effect of Interleukin-10 and CD27/CD70 Interaction," Blood 91(1):173-180, American Society of Hematology, United States (1998).
Asiedu, C., et al., "Cloning and characterization of recombinant rhesus macaque IL-10/Fc$^{ala-ala}$ fusion protein: a potential adjunct for tolerance induction strategies," Cytokine 40:183-192, Elsevier Ltd., United Kingdom (2007).
Bockermann, R., et al., "Induction of a B-cell-dependent chronic arthritis with glucose-6-phosphate isomerase," Arthritis Res. Ther. 7:R1316-R1324, BioMed Central Ltd, United Kingdom (2005).
Bruce, S.P. and Boyce, E.G., "Update on Abatacept: A Selective Costimulation Modulator for Rheumatoid Arthritis," Ann. Pharmacother. 41:1153-1162, Harvey Whitney Books Co., United States (Jul. 2007).
Butte, M.J., et al., "PD-L1 interacts specifically with B7-1 to inhibit T cell proliferation," Immunity 27:111-122, Cell Press, United States (Jul. 2007).
Cai, G., et al., "IL-10 enhances NK cell proliferation, cytotoxicity and production of IFN-γ when combined with IL-18," Eur. J. Immunol. 29:2658-2665, Wiley-VCH, Germany (1999).
Capon, D.J., et al., "Designing CD4 immunoadhesins for AIDS therapy," Nature 337:525-531, Nature Publishing Group, United Kingdom (1989).
Carosella, E.D., et al., "Beyond the increasing complexity of the immunomodulatory HLA-G molecule," Blood 111(10):4862-4870, American Society of Hematology, United States (May 2008).
Carter, L., et al., "PD-1:PD-L inhibitory pathway affects both CD4$^+$and CD8$^+$T cells and is overcome by IL-2," Eur J. Immunol. 32:634-643, Wiley-VCH, Germany (2002).
Chemnitz, J.M., et al., "B and T Lymphocyte Attenuator-Mediated Signal Transduction Provides a Ptoten Inhibitory Signal to Primary Human CD4 T Cells That Can Be Initiated by Multiple Phosphotyrosine Motifs," J. Immunol. 176:6603-6614, American Association of Immunologists, United States (2006).
Collison, L.W., et al., "The inhibitory cytokine IL-35 contributes to regulatory T-cell function," Nature 450:566-569, Nature Publishing Group, United Kingdom (Nov. 2007).
Commins, S., et al., "The extended IL-10 superfamily: IL-10, IL-19, IL-20, IL-22, IL-23, IL-26, IL-28, and IL-29," J. Allergy Clin. Immunol. 121 :1108-1111, American Academy of Allergy, Asthma & Immunology, United States (Apr. 2008).
D'Amico, G., et al., "Uncoupling of inflammatory chemokin receptors by IL-10: generation of functional decoys," Nat. Immunol. 1(5):387-391, Nature America Inc., United States (2000).
Deppong, C., et al., "Cutting Edge: B and T Lymphocyte Attenuator and Programmed Death Receptor-1 Inhibitory Receptors Are Required for Termination of Acute Allergic Airway Inflammation," J. Immunol. 176:3909-3913, American Association of Immunologist, United States (2006).
Ding, Y., et al., "A Single Amino Acid Determines the Immunostimulatory Activity of Interleukin 10," J. Exp. Med. 191(2):213-223, Rockefellar University Press, United States (2000).
Dumouter, L., and Renauld, J-C., "Viral and cellular interleukin-10 (IL-10)-related cytokines: from structures to functions," Eur. Cytokine Netw. 13(2):5-15, John Libbey Eurotext Ltd., France (2002).
Fiorentino, D.F., et al., "Two Types of Mouse T Helper Cell. IV Th2 Clones Secrete a Factor that Inhibits Cytokine Production by TH1 Clones," J. Exp. Med. 170:2081-2095, Rockefeller University Press, United States (1989).
Freeman, G.J., et al., "Engagement of the PD-1 Immunoinhibitory Receptor by a Novel B7 Family Member Leads to Negative Regulation of Lymphocyte Activation," J. Exp. Med. 192(7):1027-1034, Rockefeller University Press, United States (2000)

(56) References Cited

OTHER PUBLICATIONS

Gavrieli, M., et al., "Characterization of phosphotyrosine binding motifs in the cytoplasmic domain of B and T lymphocyte attenuator required for association with protein tyrosine phospatases SHP-1 and SHP-2," *Biochem. Biophys. Res. Commun.* 312:1236-1243, Elsevier Inc., United States (2003).

Genovese, M.C., et al., "Abatacept for Rheumatoid Arthritis Refractory to Tumor Necrosis Factor α Inhibition," *N. Engl. J. Med.* 353(11):114-1123, Massachusetts Medical Society, United States (2005).

Gesser, B., et al., "Identification of functional domains on human interleukin 10," *Proc. Natl. Acad. Sci. USA* 94:14620-14625, National Academy of Sciences, United States (1997).

Gonzalez, L.C., et al., "A coreceptor interaction between the CD28 and TNF receptor family members B and T lymphocyte attenuator and herpesvirus entry mediator," *Proc. Natl. Acad. Sci. USA* 102(4):1116-1121, National Academy of Sciences, United States (2005).

Granger, S.W. and Rickert, S., "LIGHT-HVEM signaling and the regulation of T cell-mediated immunity," *Cytokine & Growth Factor Rev.* 14:289-296, Elsevier Science Ltd., United Kingdom (2003).

Hirsch, R., et al., "Effects of in vivo administration of Anti-T3 Monoclonal Antibody on T Cell Function in Mice. I. Immunosuppression of Transplantation Responses," *J. Immunol.* 140(11):3766-3772, American Association of Immunologists, United States (1988).

Hoet, R.M., et al., "Generation of high-affinity human antibodies by combining donor-derived and synthetic complementarity-determining-region diversity," *Nature Biotechnol.* 23(3):344-348, Nature Publishing Group, United Kingdom (2005).

Holmdahl, R., "Rheumatoid arthritis viewed using a headache paradigm," *Arthritis Res.* 2:169-171, Current Science, United States (2000).

Holmdahl, R., "Dissection of the genetic complexity of arthritis using animal models," *Immunol Lett.* 103:86-91, Elsevier B.V., Netherlands (2006).

Holmdahl, R., "The Use of Animal Models for Rheumatoid Arthritis," *Methods Mol. Med.* 136(2):185-189, Humana Press, United States (2007).

Ito, W., et al., "Anti-Allergic Inflammatory Effects of Hepatocyte Growth Factor," *Int. Arch. Allergy Immunol.* 146(Suppl 1):82-87, S. Karger AG, Switzerland (2008).

Ito, W., et al., "Hepatocyte Growth Factor Attenuates Airway Hyperresponsiveness, Inflammation, and Remodeling," *Am. J. Respir. Cell. Mol. Biol.* 32:268-280, American Thoracic Society, United States (2005).

Iwanami, K., et al., "Crucial Role of the Interleukin-6/Interleukin-17 Cytokine Axis in the Induction of Arthritis by Glucose-6-Phosphate Isomerase," *Arthritis Rheum.* 58(3):754-753, American College of Rheumatology, United States (Mar. 2008).

Jirholt, J., et al., "The genetics of rheumatoid arthritis and the need for animal models to find and understand the underlying genes," *Arthritis Res.* 3:87-97, BioMed Central Ltd., United Kingdom (2001).

Kamradt, T. and Schubert, D., "The role and clinical implications of G6PI in experimental models of rheumatoid arthritis," *Arthritis Res. Ther.* 7:20-28, BioMed Central, United Kingdom (2005).

Kanamaru, F., et al., "Costimulation via Glucocorticoid-Induced TNF Receptor in Both Conventional and CD25+Regulatory CD4+T Cells," *J. Immunol.* 172:7306-7314, American Association of Immunologists, United States (2004).

Keir, M.E., et al., "PD-1 and Its Ligands in Tolerance and Immunity," *Ann. Rev. Immunol.* 26:677-704, Annual Reviews, United States (Jan. 2008).

Kohm, A.P., et al., "Cutting Edge: Ligation of the Glucocorticoid-Induced TNF Receptor Enhances Autoreactive CD4+T Cell Activation and Experimental Autoimmune Encephalomyelitis," *J. Immunol.* 172:4686-4690, American Association of Immunologists, United Staes (2004).

Kotenko, S.V., et al., "Identification and functional characterization of a second chain of the interleukin-10 receptor complex," *EMBO J.* 16(19):5894-5903, Oxford University Press, United Kingdom (1997).

Kotenko, S.V. and Pestka, S., "Jak-Stat signal transduction pathway through the eyes of cytokine class II receptor complexes," *Oncogene* 19:2557-2565, Macmillan Publishers Ltd., United Kingdom (2000).

Krieg, C., et al., "Functional analysis of B and T Lymphocyte Attenuator Engagement on CD4+ and CD8+ T Cells," *J. Immunol.* 175:6420-6427, American Association of Immunologists, United States (2005).

Lang, T.J., et al., "In Vivo CD86 Blockade Inhibits CD4+Cell Activation, Whereas CD80 Blockade Potentiates CD8+T Cell Activation of CTL Effector Function," *J. Immunol.* 168:3786-3792, American Association of Immunologists, United States (2002).

Larsen, C., et al., "Rational development of LEA29Y (belatacept), a High-Affinity Variant of CTLA4-Ig with Potent Immunosuppressive Properties," *Am. J. Tranplant.* 5:443-453, Blackwell Munksgaard, Denmark (2005).

Latchman, Y., et al., "PD-L2 is a second ligand for PD-1 and inhibits T cell activation," *Nat. Immunol.* 2(3):261-268, Nature Publishing Group, United Kingdom (2001).

Linsley, P.S., et al., "CTLA-4 Is a Second Receptor for the B Cell Activation Antigen B7," *J. Exp. Med.* 174:561-569, Rockefeller University Press, United States (1991).

Linsley, P.S., et al., "Human B7-1 (CD80) and B7-2 (CD86) bind with Similar Avidities but Distinct Kinetics to CD28 and CTLA-4 Receptors," *Immunity* 1:793-801, Cell Press, United States (1994).

Liu, Y., et al., "Expression Cloning and Characterization of a Human IL-10 Receptor," *J. Immunol.* 152: 1821-1829, American Association of Immunologists, United States (1994).

Liu, B., et al., "Glucocorticoid-induced Tumor Necrosis Factor Receptor Negatively Regulates Activation of Human Primary Natural Killer (NK) Cells By Blocking Proliferative Signals and Increasing NK Cell Apoptosis," *J. Biol. Chem.* 283(13):8202-8210, American Society for Biochemistry and Molecular Biology, United States (Mar. 2008).

Matsumoto, I., et al., "Therapeutic effects of anitbodies to tumor necrosis factor-α, interleukin-6 and cytotoxic T-lymphocyte antigen 4 immunoglobulin in mice with glucose-6-phosphate isomerase induced arthritis," *Arthritis Res. Ther.* 10:R66, 8 pages, BioMed Central Ltd., United Kingdom (Jun. 2008).

Li, M.O., and Flavell, R.A., "Contextual Regulation of Inflammation: A Duet by Transforming Growth Factor-β and Interleukin-10," *Immunity* 28:468-476, Elsevier Inc., United States (Apr. 2008).

Moore, K.W., et al., "Interleukin-10 and the Interleukin-10 Receptor," *Annu. Rev. Immunol.* 19:683-765, Annual Reviews, United States (2001).

Murphy, K.M., et al., "Balancing co-stimulation and inhibition with BTLA and HVEM," *Nat. Rev. Immunol.* 6:671-681, Nature Publishing Group, United States (2006).

Niedbala, W., et al., "IL-35 is a novel cytokine with therapeutic effects against collagen-induced arthritis through the expansion of regulatory T cells and suppression of Th17 cells," *Eur. J Immunol.* 37:3021-3029, Wiley-VCH, Germany (Nov. 2007).

Nishimura, H., and Honjo, T., "PD-1: an inhibitory immunoreceptor involved in peripheral tolerance," *Trends Immunol.* 22(5):265-268, Elsevier Science Ltd., United Kingdom (2001).

Nishimura, H., et al., "Development of Lupus-Like Autoimmune Diseases by Disruption of the PD-1 Gene Encoding an ITIM Motif-Carrying Immunoreceptor," *Immunity* 11:141-151, Cell Press, United States (1999).

Nocentini, G., et al., "GITR/GITRL: More than an effector T cell co-stimulatory system," *Eur. J. Immunol.* 37:1165-1169, Wiley-VCH, Germany (May 2007).

Okunishi, K., et al., "Hepatocyte growth Factor Significantly Suppresses Collagen-Induced Arthritis in Mice," *J. Immunol.* 179:5504-5513, American Association of Immunologists, United States (Oct. 2007).

(56) References Cited

OTHER PUBLICATIONS

Okunishi, K., et al., "A Novel Role of Hepatocyte Growth Factor as an Immune Regulator through Suppressing Dendritic Cell Function," *J. Immunol.* 175: 4745-4753, The American Association of Immunologists, United States (2005).

Patel, M., et al., "Glucocorticoid-induced TNFR family-related protein (GITR) activation exacerbates murine asthma and collagen-induced arthritis," *Eur. J., Immunol.* 35:3581-3590, Wiley-VCH, Germany (2005).

Paust, S., et al., "Engagement of l37 on effector T cells by regulatory T cells prevents autoimmune disease," *Proc. Natl. Acad. Sci. USA* 101(28):10398-10403, National Academy of Sciences, United States (2004).

Rosloniec, E.F., et al., "Collagen-Induced Arthritis," in *Current Protocols in Immunology*, eds. Coligan et al., pp. 15.5.1-15.5.24, John Wiley & Sons, Inc, United States (2003).

Schreiber, S., et al., "Safety and efficacy of recombinant human interleukin 10 in Chronic Active Crohn's Disease," *Gastroenterology* 119:1461-4872, American Gastroenterological Association, United States (2000).

Schubert, D., et al., "Immunization with Glucose-6-Phosphate Isomerase Induces T Cell-Dependent Peripheral Polyarthritis in Genetically Unaltered Mice," *J. Immunol.* 172:4503-4509, American Association of Immunologists, United States (2004).

Sedy, J.R., et al., "B and T lymphocyte attenuator regulates T cell activation through interaction with herpesvirus entry mediator," *Nat. Immunol.* 6(1):90-98, Nature Publishing Group, United Kingdom (2005).

Sharma, S., et al., "T cell-derived IL-10 promotes lung cancer growth by Suppressing Both T Cell and APC Function," *J. Immunol.* 163:5020-5028, American Association of Immunologists, United States (1999).

Suvas, S., et al., "Distinct Role of CD80 and CD86 in the Regulation of the Activation of B Cell and B Cell Lymphoma," *J. Biol. Chem.* 277(10):7766-7775, American Society for Biochemistry and Molecular Biology, United States (2002).

Taylor, P.A., et al., "B7 Expression on T cells Down-Regulates Immune Responses through CTLA-4 Ligation via T-T Interactions [corrections]," *J. Immunol.* 172:34-39, American Association of Immunologists, United States (2004).

Teft, W.A., et al., "A Molecular Perspective of CTLA-4 Function," *Annu. Rev. Immunol.* 24:65-97, Annual Reviews, United States (2006).

Nozawa, Y., et al., "A Novel Monoclonal Antibody (FUN-1) Indentifies an Activation Antigen in Cells of the B-Call Lineage and Reed Sternberg Cells," *J. Pathol.* 169:309-315, John Wiley & Sons, United Kingdom (1993).

Thompson, C.B., et al., "CD28 activation pathway regulates the production of multiple T-cell-derived lymphokines/cytokines," *Proc. Natl. Acad. Sci. USA* 86:1333-1337, National Academy of Sciences, United States (1989).

Van Den Berg, W.B., "Lessons from Animal Models of Arthritis," *Curr. Rheumatol. Rep.* 4:232-239, Current Science, United States (2002).

Vasilevko, V., et al., "CD80 (B7-1) and CD86 (B7-2) are Functionally Equivalent in the Initiation And Maintenance of CD4+ T-Cell Proliferation after Activation With Suboptimal Does of PHA," *DNA Cell Biol.* 21(3):137-149, Mary Ann Liebert, United States (2002).

Vicioso, M.-A., et al., "Moderate inhibitory effect of interleukin-10 on human neutrophil and monocyte chemotaxis in vitro," *Eur. Cytokin Netw.* 9(3):247-254, John Libbey Eurotext Ltd., France (1998).

Vieira, P., et al., "Isolation and expression of human cytokine synthesis inhibitory factor cDNA clones: homology to Epstein-Barr virus open reading frame BCRFI," *Proc. Natl. Acad. Sci. USA* 88: 1172-1176, National Academy of Sciences, United States (1991).

Watanabe, N., et al., "BTLA is a lymphocyte inhibitory receptor with similarities to CTLA-4 and PD-1," *Nat. Immunol.* 4(7):670-679, Nature America Inc., United States (2003).

Wiendl, H., et al., "The non-classical MHC molecule HLA-G protects human muscle cells from immune-mediated lysis: implications for myoblast transplantation and gene therapy," *Brain* 126:176-185, Oxford University Press, United Kingdom (2003).

Wiendle, H., et al., "Expression of the immune-tolerogenic major histocompatibility molecule HLA-G in multiple sclerosis: implications for CNS immunity," *Brain* 128:2689-2704, Oxford University Press, United Kingdom (2005).

Youngnak, P., et al., "Differential binding properites of B7-H1 and B7-DC to programmed death-1," *Biochem. Biphys. Res. Comm.* 307:672-677, Elsevier Inc., United States (2003).

Zheng, X.X., et al., "Administration of noncytolytic IL-10/Fc in Murine Models of Lipopolysaccharide-Induced Septic Shock and Allogeneic Islet Transplantation," *J. Immunol.* 154:5590-5600, American Association of Immunologists, United States (1995).

Bîrsan, T., et al., "Treatment with Humanized Monoclonal Antibodies Against CD80 And CD86 Combined with Sirolimus Prolongs Renal Allograft Survival in Cynomolgus Monkeys," *Transplantation* 75(12)2106-2113, Lippincott Williams & Wilkins, Inc., United States (2003).

Haanstra, K.G., et al., "Prevention of kidney allograft rejection using anti-CD40 and anti-CD86 in primates," *Transplantation* 75(5):637-643, Lippincott Williams & Wilkins, Inc., United States (2003).

Josephson, K., et al., "Design and Analysis of an Engineered Human Interlaukin-10 Monomer," *Biolog. Chem.* 275(18):13552-13557, American Society for Biochemistry and Molecular Biology Inc., United States (2000).

Kirk, A.D., et al., "Induction Therapy with Monoclonal Antibodies Specific for CD80 and CD86 Delays the Onset of Acute Renal Allograft Rejection in Non-Human Primates," *Transplantation* 72(3):377-384, Lippincott & Wilkins, Inc., United States (2001).

Van Gool Stefaan W, et al., "Blocking CD40- CD154 and CD80/CD86- CD28 interactions during primary allogeneic stimulation results in T cell anergy and high IL-10 production",European Journal of Immunology, vol. 29, No. 8, Aug. 1, 1999, pp. 2367-2375.

Gao J X, et al., "CD40-deficient dendritic cells producing interleukin-10, but not interleukin-12, induce T-cell hyporesponsiveness in vitro and prevent acute allograft rejection", Immunology, vol. 98, No. 2, Oct. 1, 1999, pp. 159-170.

Akdis and Blaser. (2001) Mechanisms of interleukin-10-mediated immune suppression. Immunology. 103(2): 131-6.

Asadullah et al., "Interleukin 10 Treatment of Psoriasis. Clinical Results of a Phase 2 Trial," Arch. Dermatol. 133:187-192 (1999).

Fedorak et al., "Recombinant human interleukin 10 in the treatment of patients with mild to moderately active Crohn's disease," Gastroenterology 119(6):1473-1482 (2000).

* cited by examiner

FIG. 4   The 11pM concentration is shown for each sample

CD86 ANTAGONIST MULTI-TARGET BINDING PROTEINS

CROSS-REFERENCE TO RELATED APPLICATIONS

This application is the National Stage Application of International Application No. PCT/US2009/059446, filed Oct. 2, 2009, which claims priority benefit of U.S. Provisional Patent Application Nos. 61/102,288 filed Oct. 2, 2008; 61/102,297 filed Oct. 2, 2008; 61/102,307 filed Oct. 2, 2008; 61/102,315 filed Oct. 2, 2008; 61/102,319 filed Oct. 2, 2008; 61/102,327 filed Oct. 2, 2008; 61/102,331 filed Oct. 2, 2008; 61/102,334 filed Oct. 2, 2008; and 61/102,336 filed Oct. 2, 2008, all of which are incorporated herein by reference in their entireties.

REFERENCE TO SEQUENCE LISTING SUBMITTED ELECTRONICALLY VIA EFS-WEB

The Sequence Listing associated with this application is provided in text format in lieu of a paper copy, and is hereby incorporated by reference in its entirety into the specification. The name of the text file containing the Sequence Listing is corr_sequence_listing_ascii.txt. The text file is 721,803 bytes, was created on Sep. 28, 2011, and is being submitted electronically via EFS-Web.

BACKGROUND

1. Technical Field

This disclosure relates generally to the field of multi-specific binding molecules and therapeutic applications thereof and more specifically to a fusion protein composed of a CD86 antagonist binding domain, and another binding domain that is specific for a heterologous target, such as an IL-10 agonist, an HLA-G agonist, an HGF agonist, an IL-35 agonist, a PD-1 agonist, a BTLA agonist, a LIGHT antagonist, a GITRL antagonist or a CD40 antagonist, as well as compositions and therapeutic uses thereof.

2. Description of the Related Art

The human immune system generally protects the body from damage by foreign substances and pathogens. One way in which the immune system protects the body is by producing specialized cells, referred to as T lymphocytes or T-cells. Intercellular interactions between T-cells and antigen-presenting cells (APCs) generate T-cell costimulatory signals that in turn lead to T-cell responses to antigens. Full T cell activation requires both binding of the T-cell receptor (TCR) to antigen-MHC complex present on antigen-presenting cells and binding of the receptor CD28 on the surface of the T-cell to the CD86 and/or CD80 ligands present on antigen-presenting cells, particularly dendritic cells.

CD80 (also known as B7-1) was originally described as a human B-cell associated activation antigen and was subsequently found to be a receptor for the related T-cell molecules CD28 and cytotoxic T lymphocyte-associated antigen-4 (CTLA4). In later studies, another counterreceptor for CTLA4 known as CD86 (also known as B7-0 or B7-2) was identified. CD86 shares about 25% sequence identity with CD80 in its extracellular region. While CD80 and CD86 are generally believed to be functionally equivalent in their ability to initiate and maintain proliferation of CD4(+) T cells (Vasilevko et al. (2002) DNA Cell Biol. 21:137-49), and clinical data with a soluble CTLA4 Ig fusion protein that blocks this activity for both molecules has shown clinical benefit (Genovese et al. (2005) NEJM 353:114-1123), there is some evidence that specific inhibition of CD86 might be of benefit. For example, engagement of CD86 or CD80 has different effects on B cells. Specifically, CD80 has been shown to provide a negative signal for the proliferation and IgG secretion of both normal B cells and B cell lymphomas, while CD86 enhances the activity of B cells (Suvas et al. (2002) J. Biol. Chem. 277:7766-7775). There is also some evidence that engagement of CD80 on T cells is immunosuppressive (Lang et al. (2002) J. Immunol. 168:3786-3792; Taylor et al. (2004) J. Immunol. 172:34-39; Paust et al. (2004) PNAS 101:10398-10403) and that it may mediate further immunosuppression through PD-L1 (CD274) signaling on activated APCs or T cells (Butte et al. (2007) Immunity 27:111-122; Keir (2008) Ann. Rev. Immunol. 26:677-704). Accordingly, inhibition of CD86 in the absence of CD80 inhibition may be beneficial in the treatment of autoimmune and inflammatory disease as well as B cell lymphomas.

CTLA4 is a type 1 transmembrane glycoprotein of the immunoglobulin superfamily that is mainly expressed in activated T-cells, with some expression also being found in the CD4+CD25+ regulatory T-cell (Treg) subset. CD86 and CD80 are believed to be the only endogenous ligands for CTLA4. CTLA4 has been shown to bind CD86 and CD80 with greater affinity and avidity compared with CD28 (Linsley et al. (1991) J. Exp. Med. 174:561-69; Linsley et al. (1994) Immunity 1:793-801), and plays a key role as a negative regulator of T-cell activation. Specifically, binding of CTLA4 to CD80/CD86 leads to downregulation of T-cell responses and to the preservation of T-cell homeostasis and peripheral tolerance. This is believed to be due to both antagonism of CD28-dependent costimulation and directive negative signaling through the CTLA4 cytoplasmic tail. For a review of CTLA4 structure and function, see Teft et al. (2006) Annu. Rev. Immunol. 24:65-97.

As mentioned above, a productive immune response requires both engagement of TCR and binding of CD28 to CD80 and/or CD86. TCR binding in the absence of CD28 binding leads to T cells either undergoing apoptosis or becoming anergic. In addition, CD28 signaling has been shown to increase cytokine production by T cells. Specifically, CD28 stimulation has been shown to increase production of IL-2, TNFα, lymphotoxin, IFNγ and GM-CSF 5- to 50-fold in activated T cells. Furthermore, induction of lymphokine and/or cytokine gene expression by CD28 has been shown to occur even in the presence of the immunosuppressant cyclosporine (Thompson et al. (1989) Proc. Natl. Acad. Sci. USA 86:1333-1337). CD28 has also been shown to promote T cell survival by inducing upregulation of the anti-apoptotic BCL-XL (Alegre et al. (2001) Nature Rev. Immunol. 1:220-228).

Soluble forms of CTLA4 have been constructed by fusing the variable-like extracellular domain of CTLA4 to immunoglobulin constant domains to provide CTLA4-Ig fusion proteins. Soluble CTLA-4-Ig has been shown to prevent CD28-dependent costimulation by binding to both CD86 and CD80 (Linsley et al. (1991) J. Exp. Med., 174:561-69), and to inhibit costimulation of T cells and have beneficial immunosuppression effects in humans (Bruce & Boyce (2007) Ann. Pharmacother. 41:1153-1162). The CTLA4-Ig fusion protein abatacept is currently employed for the treatment of rheumatoid arthritis in cases of inadequate response to anti-TNFα therapy. However, not all patients respond to CTLA4-Ig and continued response requires frequent drug administration, perhaps in part because blockage of interaction of CD28 with CD86/CD80 is a weak inducer of Tregs and insufficient for blocking activated effector T cell responses in a disease milieu.

DETAILED DESCRIPTION

Figure 1:
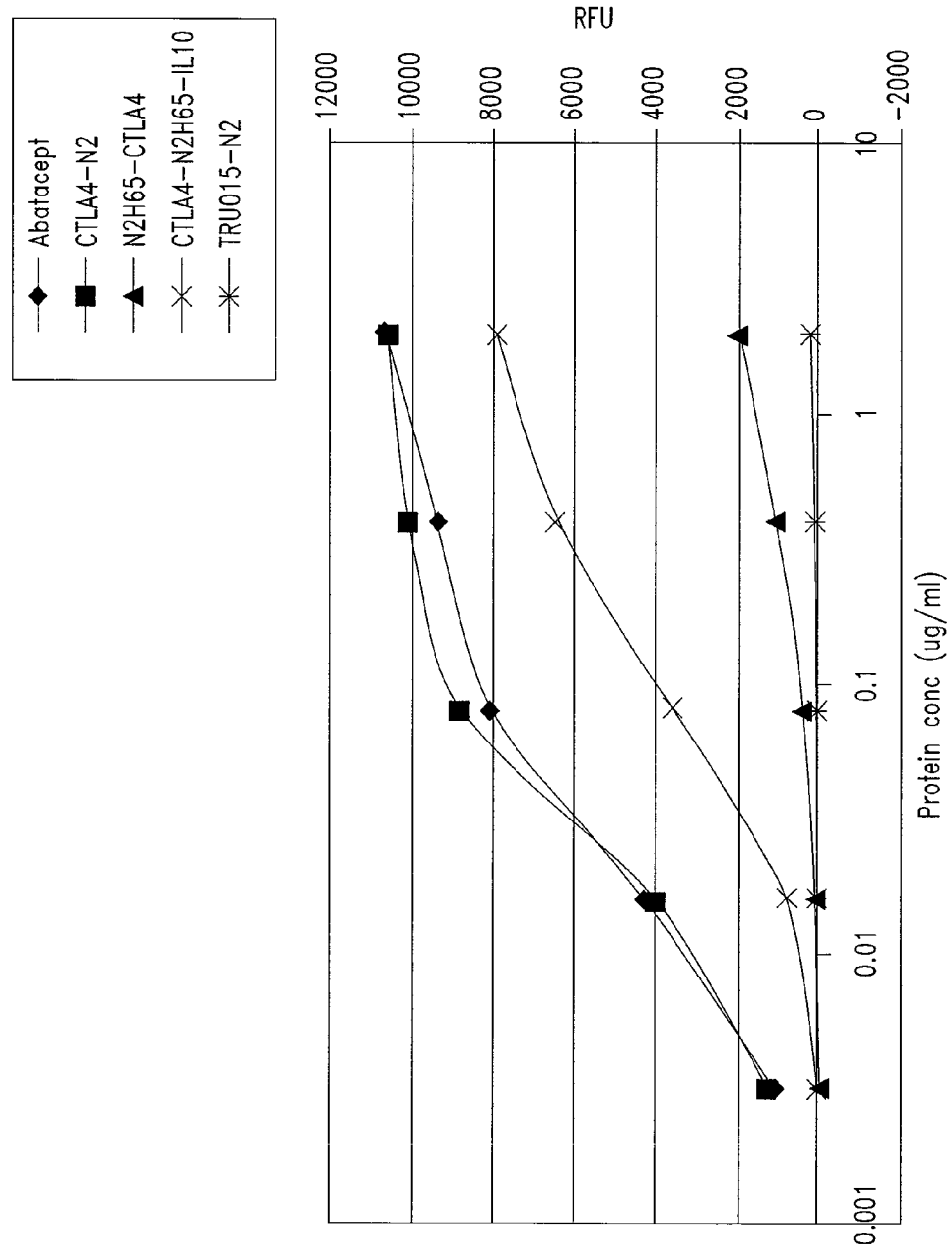
FIG. 1 shows binding to CD80 by various proteins, including abatacept, a CTLA4-Ig(N2) (SEQ ID NO:11), and a multi-specific xceptor fusion protein containing a CTLA4 ectodomain fused to an IL10 (SEQ ID NO:9).

The present disclosure makes possible the targeting of antigen presenting cells (APCs) to alter activity. For example, T-cell activity can be modulated by providing multi-specific xceptor fusion proteins that comprise a first binding domain that preferentially binds a CD86, and a second binding domain (a heterologous binding domain). In certain embodiments, a multi-specific xceptor fusion protein comprises a first and second binding domain, a first and second linker, and an intervening domain, wherein one end of the intervening domain is fused via a linker to the first binding domain that is a CD86 binding domain and the other end is fused via a linker to the second binding domain that is an IL-10 agonist, an HLA-G agonist, an HGF agonist, an IL-35 agonist, a PD-1 agonist, a BTLA agonist, a LIGHT antagonist, a GITRL antagonist or a CD40 antagonist.

In certain embodiments, the CD86 binding domain is a CTLA4 ectodomain, a CD28 ectodomain, or an immunoglobulin variable region binding domain (such as a scFv) specific for CD86 (e.g., from monoclonal antibodies 3D1 or FUN1). In some embodiments, less than an entire ectodomain is used. For example, domains within the CTLA4 ectodomain that bind CD86 and prevent binding of CD86 to CD28 can be used. In further embodiments, the IL10 agonist is IL10 or a functional region thereof. In further embodiments, the HLA-G agonist is an HLA-G5, an HLA-G1, an HLA-G mutein, or a functional region thereof; an ectodomain of an HLA-G5, an HLA-G1 or an HLA-G mutein; or an immunoglobulin variable region binding domain (such as a scFv) specific for ILT2, ILT4 or KIR2DL4. In still further embodiments, the heterologous binding domain is an HGF agonist, such as an HGF or a sub-domain thereof. In another embodiment, the heterologous binding domain is an IL35 agonist, such as an immunoglobulin variable region binding domain (such as a scFv) specific for IL35R or IL35, or a functional region thereof. In further embodiments, the LIGHT antagonist is an immunoglobulin variable region binding domain (such as a scFv) specific for LIGHT, or a HVEM ectodomain or a functional region thereof. In further embodiments, the PD-1 agonist is an immunoglobulin variable region binding domain (such as a scFv) specific for PD-1, or a PD-1 ligand (e.g. PD-L1 or PD-L2) or a functional region thereof. In further embodiments, the BTLA agonist is an immunoglobulin-like variable region binding domain (such as a scFv) specific for BTLA, or a HVEM ectodomain or a functional region thereof. In certain embodiments, the GITRL antagonist is an immunoglobulin-like variable region binding domain (such as a scFv) specific for GITRL, or a GITR ectodomain, soluble GITR, or a functional region thereof. In certain embodiments, the CD40 antagonist is an immunoglobulin-like variable region binding domain (such as a scFv) specific for CD40.

Exemplary structures of such multi-specific fusion proteins, referred to herein as Xceptor molecules, include N-BD-ID-ED-C, N-ED-ID-BD-C, N-BD1-ID-BD2-C, and N-ED-ID-ED-C, wherein N- and -C refer to the amino- and carboxy terminus, respectively; BD is an immunoglobulin-like or immunoglobulin variable region binding domain; ID is an intervening domain; and ED is an extracellular or ectodomain, such as a receptor ligand binding domain, ligand, C-type lectin domain, semaphorin or semaphorin-like domain, or the like. In some constructs, the ID can comprise an immunoglobulin constant region or sub-region disposed between the first and second binding domains. In still further constructs, the BD and ED are each linked to the ID via the same or different linker (e.g., a linker comprising one to 50 amino acids), such as an immunoglobulin hinge region (made up of, for example, the upper and core regions) or functional variant thereof, or a lectin interdomain region or functional variant thereof, or a cluster of differentiation (CD) molecule stalk region or functional variant thereof.

Prior to setting forth this disclosure in more detail, it may be helpful to an understanding thereof to provide definitions of certain terms to be used herein. Additional definitions are set forth throughout this disclosure.

In the present description, any concentration range, percentage range, ratio range, or integer range is to be understood to include the value of any integer within the recited range and, when appropriate, fractions thereof (such as one tenth and one hundredth of an integer), unless otherwise indicated. Also, any number range recited herein relating to any physical feature, such as polymer subunits, size or thickness, are to be understood to include any integer within the recited range, unless otherwise indicated. As used herein, "about" or "consisting essentially of" mean±20% of the indicated range, value, or structure, unless otherwise indicated. It should be understood that the terms "a" and "an" as used herein refer to "one or more" of the enumerated components. The use of the alternative (e.g., "or") should be understood to mean either one, both, or any combination thereof of the alternatives. As used herein, the terms "include" and "comprise" are used synonymously. In addition, it should be understood that the individual compounds, or groups of compounds, derived from the various combinations of the structures and substituents described herein, are disclosed by the present application to the same extent as if each compound or group of compounds was set forth individually. Thus, selection of particular structures or particular substituents is within the scope of the present disclosure.

A "binding domain" or "binding region" according to the present disclosure may be, for example, any protein, polypeptide, oligopeptide, or peptide that possesses the ability to specifically recognize and bind to a biological molecule (e.g., CD86) or a complex of more than one of the same or different molecule or assembly or aggregate, whether stable or transient (e.g. CD86/CD28 complex). Such biological molecules include proteins, polypeptides, oligopeptides, peptides, amino acids, or derivatives thereof; lipids, fatty acids, or derivatives thereof; carbohydrates, saccharides, or derivatives thereof; nucleotides, nucleosides, peptide nucleic acids, nucleic acid molecules, or derivatives thereof; glycoproteins, glycopeptides, glycolipids, lipoproteins, proteolipids, or derivatives thereof; other biological molecules that may be present in, for example, a biological sample; or any combination thereof. A binding region includes any naturally occurring, synthetic, semi-synthetic, or recombinantly produced binding partner for a biological molecule or other target of interest. A variety of assays are known for identifying binding domains of the present disclosure that specifically bind with a particular target, including FACS, Western blot, ELISA, or Biacore analysis.

Binding domains and fusion proteins thereof of this disclosure can be capable of binding to a desired degree, including "specifically or selectively binding" a target while not significantly binding other components present in a test sample, if they bind a target molecule with an affinity or $K_a$ (i.e., an equilibrium association constant of a particular binding interaction with units of 1/M) of, for example, greater than or equal to about $10^5$ $M^{-1}$, $10^6$ $M^{-1}$, $10^7$ $M^{-1}$, $10^8$ $M^{-1}$, $10^9$ $M^{-1}$, $10^{10}$ $M^{-1}$, $10^{11}$ $M^{-1}$, $10^{12}$ $M^{-1}$, or $10^{13}$ $M^{-1}$. "High affinity" binding domains refers to those binding domains with a $K_a$ of at least $10^7$ $M^{-1}$, at least $10^8$ $M^{-1}$, at least $10^9$ $M^{-1}$, at least $10^{10}$ $M^{-1}$, at least $10^{11}$ $M^{-1}$, at least $10^{12}$ $M^{-1}$, at least $10^{13}$ $M^{-1}$, or greater. Alternatively, affinity may be defined as an equilibrium dissociation constant ($K_d$) of a particular binding interaction with units of M (e.g., $10^{-5}$ M to $10^{-13}$ M). Affinities of binding domain polypeptides and fusion proteins according to the present disclosure can be readily determined using conventional techniques (see, e.g., Scatchard et al. (1949) Ann. N.Y. Acad. Sci. 51:660; and U.S. Pat. Nos. 5,283,173; 5,468,614, or the equivalent).

Binding domains of this disclosure can be generated as described herein or by a variety of methods known in the art (see, e.g., U.S. Pat. Nos. 6,291,161; 6,291,158). Sources include antibody gene sequences from various species (which can be formatted as antibodies, sFvs, scFvs or Fabs, such as in a phage library), including human, camelid (from camels, dromedaries, or llamas; Hamers-Casterman et al. (1993) Nature, 363:446 and Nguyen et al. (1998) J. Mol. Biol., 275:413), shark (Roux et al. (1998) Proc. Nat'l. Acad. Sci. (USA) 95:11804), fish (Nguyen et al. (2002) Immunogenetics, 54:39), rodent, avian, ovine, sequences that encode random peptide libraries or sequences that encode an engineered diversity of amino acids in loop regions of alternative non-antibody scaffolds, such as fibrinogen domains (see, e.g., Weisel et al. (1985) Science 230:1388), Kunitz domains (see, e.g., U.S. Pat. No. 6,423,498), lipocalin domains (see, e.g., WO 2006/095164), V-like domains (see, e.g., US Patent Application Publication No. 2007/0065431), C-type lectin domains (Zelensky and Gready (2005) FEBS J. 272:6179), $mAb^2$ or Fcab™ (see, e.g., PCT Patent Application Publication Nos. WO 2007/098934; WO 2006/072620), or the like. Additionally, traditional strategies for hybridoma development using, for example, a synthetic single chain CD86 as an immunogen in convenient systems (e.g., mice, HuMAb Mouse®, TC Mouse®, KM-Mouse®, llamas, chicken, rats, hamsters, rabbits, etc.) can be used to develop binding domains of this disclosure.

Terms understood by those in the art as referring to antibody technology are each given the meaning acquired in the art, unless expressly defined herein. For example, the terms "$V_L$" and "$V_H$" refer to the variable binding region derived from an antibody light and heavy chain, respectively. The variable binding regions are made up of discrete, well-defined sub-regions known as "complementarity determining regions" (CDRs) and "framework regions" (FRs). The terms "$C_L$" and "$C_H$" refer to an "immunoglobulin constant region," i.e., a constant region derived from an antibody light or heavy chain, respectively, with the latter region understood to be further divisible into $C_{H1}$, $C_{H2}$, $C_{H3}$ and $C_{H4}$ constant region domains, depending on the antibody isotype (IgA, IgD, IgE, IgG, IgM) from which the region was derived. A portion of the constant region domains makes up the Fc region (the "fragment crystallizable" region), which contains domains responsible for the effector functions of an immunoglobulin, such as ADCC (antibody-dependent cell-mediated cytotoxicity), CDC (complement-dependent cytotoxicity) and complement fixation, binding to Fc receptors, greater half-life in vivo relative to a polypeptide lacking an Fc region, protein A binding, and perhaps even placental transfer (see Capon et al. (1989) Nature, 337:525). Further, a polypeptide containing an Fc region allows for dimerization or multimerization of the polypeptide. A "hinge region," also referred to herein as a "linker," is an amino acid sequence interposed between and connecting the variable binding and constant regions of a single chain of an antibody, which is known in the art as providing flexibility in the form of a hinge to antibodies or antibody-like molecules.

The domain structure of immunoglobulins is amenable to engineering, in that the antigen binding domains and the domains conferring effector functions may be exchanged between immunoglobulin classes and subclasses. Immunoglobulin structure and function are reviewed, for example, in Harlow et al., Eds., *Antibodies: A Laboratory Manual*, Chapter 14 (Cold Spring Harbor Laboratory, Cold Spring Harbor, 1988). An extensive introduction as well as detailed information about all aspects of recombinant antibody technology can be found in the textbook *Recombinant Antibodies* (John Wiley & Sons, NY, 1999). A comprehensive collection of detailed antibody engineering lab Protocols can be found in R. Kontermann and S. Dübel, Eds., *The Antibody Engineering Lab Manual* (Springer Verlag, Heidelberg/New York, 2000). Further related protocols are also available in *Current Protocols in Immunology* (August 2009) published by John Wiley & Sons, Inc., Boston, Mass.

"Derivative" as used herein refers to a chemically or biologically modified version of a compound that is structurally similar to a parent compound and (actually or theoretically) derivable from that parent compound. Generally, a "derivative" differs from an "analogue" in that a parent compound may be the starting material to generate a "derivative," whereas the parent compound may not necessarily be used as the starting material to generate an "analogue." An analogue may have different chemical or physical properties of the parent compound. For example, a derivative may be more hydrophilic or it may have altered reactivity (e.g., a CDR having an amino acid change that alters its affinity for a target) as compared to the parent compound.

The term "biological sample" includes a blood sample, biopsy specimen, tissue explant, organ culture, biological fluid (e.g., serum, urine, CSF) or any other tissue or cell or other preparation from a subject or a biological source. A subject or biological source may, for example, be a human or non-human animal, a primary cell culture or culture adapted cell line including genetically engineered cell lines that may contain chromosomally integrated or episomal recombinant nucleic acid sequences, somatic cell hybrid cell lines, immortalized or immortalizable cell lines, differentiated or differentiatable cell lines, transformed cell lines, or the like. In further embodiments of this disclosure, a subject or biological source may be suspected of having or being at risk for having a disease, disorder or condition, including a malignant disease, disorder or condition or a B cell disorder. In certain embodiments, a subject or biological source may be suspected of having or being at risk for having a hyperproliferative, inflammatory, or autoimmune disease, and in certain other embodiments of this disclosure the subject or biological source may be known to be free of a risk or presence of such disease, disorder, or condition.

CD86 Binding Domains

As set forth herein, CD86 comprises a type I membrane protein that is a member of the immunoglobulin superfamily. CD86 is expressed by antigen-presenting cells, and is the ligand for the two T-cell proteins CD28 and CTLA4. Binding of CD28 with CD28 is a costimulatory signal for activation of the T-cell, while binding of CD28 with CTLA4 downregulates T-cell activation and reduces the immune response. Alternative splicing results in two transcript variants encoding different isoforms (GenBank™ Accessions NP_787058.3 and NP_008820.2).

A CD86 binding domain of this disclosure can block binding of CD86 to CD28 and thereby downregulate T-cell activation. CD86 binding domains contemplated include a CTLA4 extracellular domain, or sub-domain thereof, a CD28 extracellular domain or sub-domain, or a CD86-specific antibody-derived binding domain (such as derived from the FUN1 monoclonal antibody (see e.g., J. Pathol. 1993 March; 169(3):309-15); or derived from the 3D1 anti-CD86 monoclonal antibody.

In some embodiments, a CD86 binding domain is an extracellular domain ("ectodomain") of a human CTLA4 (GenBank™ Accession NP_005205), such as the mature polypeptide sequence of SEQ ID NO: 1 (signal peptide: amino acids 1-37). The amino acid sequence of the CTLA4 ectodomain without the signal peptide is provided in SEQ ID NO: 410. Applicants note that certain studies have indicated that the mature polypeptide of the CTLA4 ectodomain begins at the methionine at position 38 of SEQ ID NO: 1, other studies have indicated that the mature polypeptide begins at the alanine at position 37. In further embodiments, a CD86 binding domain is an ectodomain of CTLA4 that has been mutated in order to have a higher avidity for CD86 than wildtype, or non-mutated, CTLA4 as disclosed, for example, in US Patent Publication No. US 2003/0035816. In certain embodiments, the mutated CTLA4 ectodomain comprises an alanine or tyrosine at amino acid position 29, and/or a glutamic acid, asparagine, aspartic acid, glutamine, isoleucine, leucine or threonine at position 104 of SEQ ID NO:410. The amino acid sequence for the A29Y L104E CTLA 4 ectodomain variant is provided in SEQ ID NO:411. In certain embodiments, a CD86 binding domain is a CTLA-4 variable-like domain, such as the sequence provided in SEQ ID NO:3, or a CDR of a CTLA-4 variable-like domain, such as SEQ ID NO: 4 (CDR1), SEQ ID NO:5, (CDR2) or SEQ ID NO:6 (CDR3). Such CDRs are described, for example, in U.S. Pat. No. 7,405,288. In alternative embodiments, a CD86 binding domain is an extracellular domain ("ectodomain") of a CD28 (GenBank™ Accession NP_006130.1), such as the sequence provided in SEQ ID NO:2. Amino acids 1-18 of SEQ ID NO:2 are the signal peptide. The amino acid sequence of the ectodomain of CD28 without the signal peptide is provided in SEQ ID NO:412.

In yet further embodiments, a CD86 binding domain comprises a single chain immunoglobulin-like domain, such as a scFv, that is specific for CD86. In certain embodiments, the CD86 binding domain contains the light and heavy variable binding domains from monoclonal antibody FUN1 or 3D1. In certain embodiments, a CD86 binding domain comprises amino acids 1-258 of SEQ ID NO:187 or 237. The sequences for the heavy chain, light chain, scFv linker, and CDRs from the FUN1 and 3D1 anti-CD86 monoclonal antibodies are set forth in SEQ NOS:305-313 and 318-326, respectively, which can be used in the xceptor molecules of the instant disclosure.

In one aspect, a CD86 binding domain or fusion protein thereof of this disclosure is specific for CD86 and has an affinity with a dissociation constant ($K_d$) of about $10^{-3}$ M to less than about $10^{-8}$ M. In certain preferred embodiments, the CD86 binding domain or fusion protein thereof binds CD86 with an affinity of about 0.3 μM.

In an illustrative example, CD86 binding domains of this disclosure can be identified using a Fab phage library of fragments (see, e.g., Hoet et al. (2005) Nature Biotechnol. 23:344) by screening for binding to a synthetic or recombinant CD86 (using an amino acid sequence or fragment thereof as set forth in GenBank™ Accession No. NP_787058.3 or NP_008820.2). In certain embodiments, a CD86 molecule used to generate a CD86 binding domain can further comprise an intervening domain or a dimerization domain, as described herein, such as an immunoglobulin Fc domain or fragment thereof.

In some embodiments, CD86 binding domains of this disclosure comprise $V_H$ and $V_L$ domains as described herein (e.g., FUN1, 3D1, or humanized derivatives thereof). Other exemplary $V_H$ and $V_L$ domains include those described in U.S. Pat. No. 6,827,934. In certain embodiments, the $V_H$ and $V_L$ domains are human. In further embodiments, there are provided CD86 binding domains of this disclosure that have a sequence that is at least 90%, at least 91%, at least 92%, at least 93%, at least 94%, at least 95%, at least 96%, at least 97%, at least 98%, at least 99%, at least 99.5%, or at least 100% identical to the amino acid sequence of one or more light chain variable regions ($V_L$) or to one or more heavy chain variable regions ($V_H$), or both, of SEQ NOS:305 and 306, SEQ NOS:318 and 319, or those disclosed in U.S. Pat. No. 6,827,934 (incorporated herein by reference), wherein each CDR can have zero, one, two, or three amino acid changes (i.e., most changes are in the framework region(s)).

The terms "identical" or "percent identity," in the context of two or more polypeptide or nucleic acid molecule sequences, means two or more sequences or subsequences that are the same or have a specified percentage of amino acid residues or nucleotides that are the same over a specified region (e.g., 60%, 65%, 70%, 75%, 80%, 85%, 90%, 91%, 92%, 93%, 94%, 95%, 96%, 97%, 98%, 99%, or 100% identity), when compared and aligned for maximum correspondence over a comparison window, or designated region, as measured using methods known in the art, such as a sequence comparison algorithm, by manual alignment, or by visual inspection. For example, preferred algorithms suitable for determining percent sequence identity and sequence similarity are the BLAST and BLAST 2.0 algorithms, which are described in Altschul et al. (1977) Nucleic Acids Res. 25:3389 and Altschul et al. (1990) J. Mol. Biol. 215:403, respectively.

In any of these or other embodiments described herein where $V_L$ and $V_H$ domains may be desired, the $V_L$ and $V_H$ domains may be arranged in either orientation and may be separated by up to about a 30 amino acid linker as disclosed herein or any amino acid sequence capable of providing a spacer function compatible with interaction of the two sub-binding domains. In certain embodiments, a linker joining the $V_H$ and $V_L$ domains comprises an amino acid sequence as set forth in any one or more of SEQ ID NOS: 43-166, 244, 307, 320, 355-379 and 383-398, such as Linker 46 (SEQ ID NO:88), Linker 130 (SEQ ID NO:163), Linker 131 (SEQ ID NO:164), Linker 115 (SEQ ID NO:148), or the linker provided in SEQ ID NO:244. Multi-specific binding domains will have at least two specific sub-binding domains, by analogy to camelid antibody organization, or at least four specific sub-binding domains, by analogy to the more conventional mammalian antibody organization of paired $V_H$ and $V_L$ chains.

CDRs are defined in various ways in the art, including the Kabat, Chothia, AbM, and contact definitions. The Kabat definition is based on sequence variability and is the most commonly used definition to predict CDR regions (Johnson et al. (2000) Nucleic Acids Res. 28:214). The Chothia definition is based on the location of the structural loop regions (Chothia et al. (1986) J. Mol. Biol. 196:901; Chothia et al. (1989) Nature 342:877). The AbM definition, a compromise between the Kabat and Chothia definitions, is an integral suite of programs for antibody structure modeling produced by the Oxford Molecular Group (Martin et al. (1989) Proc. Nat'l. Acad. Sci. (USA) 86:9268; Rees et al., ABM™, a computer program for modeling variable regions of antibodies, Oxford, UK; Oxford Molecular, Ltd.). An additional definition, known as the contact definition, has been recently introduced (see MacCallum et al. (1996) J. Mol. Biol. 5:732), which is based on analysis of available complex crystal structures.

By convention, the CDR domains in the heavy chain are referred to as H1, H2, and H3, which are numbered sequentially in order moving from the amino terminus to the carboxy terminus. The CDR-H1 is about ten to 12 residues in length and starts four residues after a Cys according to the Chothia and AbM definitions, or five residues later according to the Kabat definition. The H1 can be followed by a Trp, Trp-Val, Trp-Ile, or Trp-Ala. The length of H1 is approximately ten to 12 residues according to the AbM definition, while the Chothia definition excludes the last four residues. The CDR-H2 starts 15 residues after the end of H1 according to the Kabat and AbM definitions, which is generally preceded by sequence Leu-Glu-Trp-Ile-Gly (but a number of variations are known) and is generally followed by sequence Lys/Arg-Leu/Ile/Val/Phe/Thr/Ala-Thr/Ser/Ile/Ala. According to the Kabat definition, the length of H2 is about 16 to 19 residues, while the AbM definition predicts the length to be nine to 12 residues. The CDR-H3 usually starts 33 residues after the end of H2, is generally preceded by the amino acid sequence Cys-Ala-Arg and followed by the amino acid Gly, and has a length that ranges from three to about 25 residues.

By convention, CDR regions in the light chain are referred to as L1, L2, and L3, which are numbered sequentially in order moving from the amino terminus to the carboxy terminus. The CDR-L1 (approximately ten to 17 residues in length) generally starts at about residue 24 and generally follows a Cys. The residue after the CDR-L1 is always Trp, which begins one of the following sequences: Trp-Tyr-Gln, Trp-Leu-Gln, Trp-Phe-Gln, or Trp-Tyr-Leu. The CDR-L2 (about seven residues in length) starts about 16 residues after the end of L1 and will generally follow residues Ile-Tyr, Val-Tyr, Ile-Lys, or Ile-Phe. The CDR-L3 usually starts 33 residues after the end of L2 and generally follows a Cys, which is generally followed by the sequence Phe-Gly-XXX-Gly and has a length of about seven to 11 residues.

Thus, a binding domain of this disclosure can comprise a single CDR from a variable region of an anti-CD86 antibody, or it can comprise multiple CDRs that can be the same or different. In certain embodiments, binding domains of this disclosure comprise $V_H$ and $V_L$ domains specific for a CD86 comprising framework regions and CDR1, CDR2 and CDR3 regions, wherein (a) the $V_H$ domain comprises an amino acid sequence of a heavy chain CDR3; or (b) the $V_L$ domain comprises an amino acid sequence of a light chain CDR3; or (c) the binding domain comprises a $V_H$ amino acid sequence of (a) and a $V_L$ amino acid sequence of (b); or the binding domain comprises a $V_H$ amino acid sequence of (a) and a $V_L$ amino acid sequence of (b) and wherein the $V_H$ and $V_L$ are found in the same reference sequence. In further embodiments, binding domains of this disclosure comprise $V_H$ and $V_L$ domains specific for an CD86 comprising framework regions and CDR1, CDR2 and CDR3 regions, wherein (a) the $V_H$ domain comprises an amino acid sequence of a heavy chain CDR1, CDR2, and CDR3; or (b) the $V_L$ domain comprises an amino acid sequence of a light chain CDR1, CDR2, and CDR3; or (c) the binding domain comprises a $V_H$ amino acid sequence of (a) and a $V_L$ amino acid sequence of (b); or the binding domain comprises a $V_H$ amino acid sequence of (a) and a $V_L$ amino acid sequence of (b), wherein the $V_H$ and $V_L$ amino acid sequences are from the same reference sequence.

In any of the embodiments described herein comprising specific CDRs, a binding domain can comprise (i) a $V_H$ domain having an amino acid sequence that is at least 80%, 85%, 90%, 91%, 92%, 93%, 94%, 95%, 96%, 97%, 98%, or 99% identical to the amino acid sequence of a $V_H$ domain; or (ii) a $V_L$ domain having an amino acid sequence that is at least 80%, 85%, 90%, 91%, 92%, 93%, 94%, 95%, 96%, 97%, 98%, or 99% identical to the amino acid sequence of a $V_L$ domain; or (iii) both a $V_H$ domain of (i) and a $V_L$ domain of (ii); or both a $V_H$ domain of (i) and a $V_L$ domain of (ii) wherein the $V_H$ and $V_L$ are from the same reference sequence, wherein each CDR has up to three amino acid changes (i.e., many of the changes are in the framework region(s)).

A CD86 binding domain in xceptor fusion proteins of this disclosure may be an immunoglobulin-like domain, such as an immunoglobulin scaffold. Immunoglobulin scaffolds contemplated by this disclosure include a scFv, a domain antibody, or a heavy chain-only antibody. In a scFv, this disclosure contemplates the heavy and light chain variable regions are joined by any linker peptide described herein or known in the art to be compatible with joining domains or regions in a binding molecule. Exemplary linkers are linkers based on the Gly$_4$Ser linker motif, such as (Gly$_4$Ser)$_n$, where n=1-5. If a binding domain of a fusion protein of this disclosure is based on a non-human immunoglobulin or includes non-human CDRs, the binding domain may be "humanized" according to methods known in the art.

Alternatively, a CD86 binding domain of fusion proteins of this disclosure may be a scaffold other than an immunoglobulin scaffold. Other scaffolds contemplated by this disclosure present the CD86-specific CDR(s) in a functional conformation. Other scaffolds contemplated include, but are not limited an A domain molecule, a fibronectin III domain, an anticalin, an ankyrin-repeat engineered binding molecule, an adnectin, a Kunitz domain or a protein AZ domain affibody.

IL10

As noted above, in certain embodiments the present disclosure provides polypeptides containing a binding region or domain that is an IL10 agonist (i.e., can increase IL10 signaling). In some embodiments, the IL10 agonist binding domain is an IL10 or a IL10Fc, or a functional sub-domain thereof. In other embodiments, the IL10 agonist binding domain is a single chain binding protein, such as an scFv, that specifically binds to IL10R1 or IL10R2. In some embodiments, the IL10 agonist binding domain is an IL10 containing a point mutation at position 87 of SEQ ID NO:7, such as from "I" to "A" or "S" (referred to herein as I87A or I87S, respectively). The I87 variant IL10 molecules are known to be less immuno-stimulatory compared to wildtype IL10 (Ding et al., J. Exp. Med. 191:213, 2000). Additionally, IL10 normally forms a homodimer with the amino terminal domain of each monomer molecule binding to the carboxy terminal domain of the other monomer). In one embodiment, the IL10 agonist binding domain is an IL10 molecule having a short linker (gggsgg SEQ ID NO:379) that separates the two subdomains of the molecule (amino and carboxy end domains) so that these subdomains can form an intramolecular dimer was also examined. These are referred to herein as monoIL10 molecules. In certain embodiments, an IL10 comprises an amino acid sequence selected from the group consisting of SEQ ID NOs:380-382.

IL10 (GenBank™ Accession no. NP_000563.1; SEQ ID NO:7) is a member of a cytokine superfamily that share an alpha-helical structure. Amino acids 1-18 of SEQ ID NO:7 are the signal peptide of the precursor IL10 protein. The amino acid sequence of the mature IL10 protein is provided in SEQ ID NO:418. Although no empirical evidence exists, it has been suggested that all the family members possess six alpha-helices (Fickenscher, H. et al., (2002) Trends Immunol. 23: 89). IL10 has four cysteines, only one of which is conserved among family members. Since IL10 demonstrates a V-shaped fold that contributes to its dimerization, it appears that disulfide bonds are not critical to this structure. Amino acid identity of family members to IL10 ranges from 20% (IL-19) to 28% (IL-20) (Dumouter et al., (2002) Eur. Cytokine Netw. 13:5).

IL10 was first described as a Th2 cytokine in mice that inhibited IFN-α and GM-CSF cytokine production by Th1 cells (Moore et al., 2001, Annu. Rev. Immunol. 19:683; Fiorentino et al., (1989) J. Exp. Med. 170: 2081). Human IL10 is 178 amino acids in length with an 18 amino acid signal sequence and a 160 amino acid mature segment. Its molecular weight is approximately 18 kDa (monomer). Human IL10 contains no potential N-linked glycosylation site and is not glycosylated (Dumouter et al., (2002) Eur. Cytokine Netw. 13:5; Vieira et al., (1991) Proc. Natl. Acad. Sci. USA 88:1172). It contains four cysteine residues that form two intrachain disulfide bonds. Helices A→D of one monomer noncovalently interact with helices E and F of a second monomer, forming a noncovalent V-shaped homodimer. Functional areas have been mapped on the IL10 molecule. In the N-terminus, pre-helix A residues #1-9 are involved in mast cell proliferation, while in the C-terminus, helix F residues #152-160 mediate leukocyte secretion and chemotaxis.

Cells known to express IL10 include CD8+ T cells, microglia, CD14+ (but not CD16+) monocytes, Th2 CD4+ cells (mice), keratinocytes, hepatic stellate cells, Th1 and Th2 CD4+ T cells (human), melanoma cells, activated macrophages, NK cells, dendritic cells, B cells (CD5+ and CD19+) and eosinophils. On T cells, the initial observation of IL10 inhibition of IFN-gamma production is now suggested to be an indirect effect mediated by accessory cells. Additional effects on T cells, however, include: IL10 induced CD8+ T cell chemotaxis, an inhibition of CD4+ T cell chemotaxis towards IL-8, suppression of IL-2 production following activation, an inhibition of T cell apoptosis via Bcl-2 up-regulation, and an interruption of T cell proliferation following low antigen exposure accompanied by CD28 costimulation (Akdis et al., (2001) Immunology 103: 131).

On B cells, IL10 has a number of related, yet distinct functions. In conjunction with TNF-β and CD40L, IL10 induces IgA production in naïve (IgD+) B cells. It is believed that TGF-β/CD40L promotes class switching while IL10 initiates differentiation and growth. When TGF-β is not present, IL10 cooperates with CD40L in inducing IgG1 and IgG3 (human), and thus may be a direct switch factor for IgG subtypes. Interestingly, IL10 has divergent effects on IL-4 induced IgE secretion. If IL10 is present at the time of IL-4 induced class switching, it reverses the effect; if it is present after IgE commitment, it augments IgE secretion. Finally, CD27/CD70 interaction in the presence of IL10 promotes plasma cell formation from memory B cells (Agematsu et al., (1998) Blood 91: 173).

Mast cells and NK cells are also impacted by IL10. On mast cells, IL10 induces histamine release while blocking GM-CSF and TNF-α release. This effect may be autocrine as IL10 is known to be released by mast cells in rat. As evidence of its pleiotrophic nature, IL10 has the opposite effects on NK cells. Rather than blocking TNF-α and GM-CSF production, IL10 actually promotes this function on NK cells. In addition, it potentiates IL-2 induced NK cell proliferation and facilitates IFN-γ secretion in NK cells primed by IL-18. In concert with both IL-12 and/or IL-18, IL10 potentiates NK cell cytotoxicity (Cai et al., 1999, Eur. J. Immunol. 29: 2658).

IL10 has a pronounced anti-inflammatory impact on neutrophils. It inhibits the secretion of the chemokines MIP-1α, MIP-1β and IL-8, and blocks production of the proinflammatory mediators IL-1β and TNF-α. In addition, it decreases the ability of neutrophils to produce superoxide, and as a result interferes with PMN-mediated antibody-dependent cellular cytotoxicity. It also blocks IL-8 and fMLP-induced chemotaxis, possibly via CXCR1 (Vicioso et al., (1998) Eur. Cytokine Netw. 9:247).

On dendritic cells (DCs), IL10 generally exhibits immunosuppressive effects. It would appear to promote CD14+ macrophage differentiation at the expense of DCs. IL10 seems to decrease the ability of DCs to stimulate T cells, particularly for Th1 type cells. Relative to MHC-II expression, it can be down-regulated, unchanged, or up-regulated (Sharma et al., (1999) J. Immunol. 163:5020). With respect to CD80 and CD86, IL10 will either up-regulate or down-regulate its expression. B7-2/CD86 plays a key role in T cell activation. For this molecule, IL10 is involved in both up-regulation and down-regulation. Perhaps the most significant modulation, however, occurs with CD40 (IL10 seems to reduce its expression). At the regional level, MO may block immunostimulation by inhibiting Langerhans cell migration in response to proinflammatory cytokines. Alternatively, IL10 blocks an inflammation-induced DC maturation step that normally involves CCR1, CCR2 and CCR5 down-regulation and CCR7 up-regulation. This blockage, with retention of CCR1, CCR2 and CCR5, results in a failure of DCs to migrate to regional nodes. The result is an immobile DC that will not stimulate T cells but will bind (and clear) proinflammatory chemokines without responding to them (D-Amico et al., (2000) Nat. Immunol. 1:387).

On monocytes, IL10 has a number of documented effects. For example, IL10 seems to clearly reduce cell surface MHC-II expression. It also inhibits IL-12 production following stimulation. While it promotes a monocyte to macrophage transition in conjunction with M-CSF, the phenotype of the macrophage is not clear (i.e. CD16+/cytotoxic vs. CD16−). IL10 also reduces monocyte GM-CSF secretion and IL-8 production, while promoting IL-1ra release (Gesser et al., (1997) Proc. Natl. Acad. Sci. USA 94:14620). Hyaluronectin, a connective tissue component, is now known to be secreted by monocytes in response to IL10. This may have some importance in cell migration, particularly tumor cell metastases, where hyaluronectin is known to interrupt cell migration through extracellular space (Gesser et al., (1997) Proc. Natl. Acad. Sci. USA 94:14620).

Fusion proteins of IL10 with either murine or macaque Fc regions (referred to as IL10Fc) have been shown to inhibit macrophage function and prolong pancreatic islet xenograft survival (Feng et al. (1999) Transplantation 68:1775; Asiedu et al. (2007) Cytokine 40:183), as well as reduce septic shock in a murine model (Zheng et al. (1995) J. Immunol. 154:5590).

Human IL10R1 is a 90-110 kDa, single-pass type I transmembrane glycoprotein that is expressed on a limited number of cell types (Liu et al., 1994, J. Immunol. 152: 1821). Weak expression being seen in pancreas, skeletal muscle, brain, heart, and kidney. Placenta, lung, and liver showed intermediate levels. Monocytes, B-cells, large granular lymphocytes, and T-cells express high levels (Liu et al., 1994, J. Immunol. 152: 1821). The expressed protein is a 578 amino acid protein that contains a 21 amino acid signal peptide, a 215 amino acid extracellular region, a 25 amino acid transmembrane segment, and a 317 amino acid cytoplasmic domain. There are two FNIII motifs within the extracellular region and a STAT3 docking site plus a JAK1 association region within the cytoplasmic domain (Kotenko et al., 2000 Oncogene 19: 2557; Kotenko et al., 1997, EMBO J. 16: 5894). IL10R1 binds human IL10 with a Kd of 200 pM.

In some embodiments, binding domains of this disclosure comprise $V_L$ and $V_H$ domains specific for an IL10R1 or IL10R2 as described herein. In certain embodiments, the $V_L$ and $V_H$ domains are human. The $V_L$ and $V_H$ domains may be arranged in either orientation and may be separated by up to about a 30 amino acid linker as disclosed herein or any other amino acid sequence capable of providing a spacer function compatible with interaction of the two sub-binding domains. In certain embodiments, a linker joining the $V_L$ and $V_H$ domains comprises an amino acid sequence as set forth in SEQ ID NOs:43-166, 244, 307, 320, 355-379 and 383-398, such as the linker provided in SEQ ID NO:244, Linker 46 (SEQ ID NO:88), Linker 130 (SEQ ID NO:163), or Linker 131 (SEQ ID NO:164). Multi-specific binding domains can have at least two specific sub-binding domains, by analogy to camelid antibody organization, or at least four specific sub-binding domains, by analogy to the more conventional mammalian antibody organization of paired $V_L$ and $V_H$ chains. In further embodiments, binding domains specific for IL10R1 or IL10R2 of this disclosure may comprise one or more complementarity determining region ("CDR"), or multiple copies of one or more such CDRs, which have been obtained, derived, or designed from variable regions of an anti-IL10R1 or IL10R2 scFv or Fab fragment or from heavy or light chain variable regions thereof. Thus, a binding domain of this disclosure can comprise a single CDR from a variable region of an anti-IL10R1 or IL10R2, or it can comprise multiple CDRs that can be the same or different. In certain embodiments, binding domains of this disclosure comprise $V_L$ and $V_H$ domains specific for an IL10R1 or IL10R2 comprising framework regions and CDR1, CDR2 and CDR3 regions.

HLA-G

As noted above, in certain embodiments the present disclosure provides polypeptides containing a binding region or domain that is an HLA-G agonist (i.e., can increase HLA-G signaling). In some embodiments, the HLA-G agonist binding domain is an HLA-G1 (SEQ ID NO: 14), an HLA-G5 (SEQ ID NO: 15) or an HLA-G mutein in which the cysteine at position of 147 of the mature protein has been mutated to an alternative amino acid, for example a serine. Amino acids 1-24 and 1-23 of HLA-G1 and HLA-G5, respectively, represent the signal peptides. In other embodiments, the HLA-G agonist domain is an ectodomain of HLA-G1 or HLA-G5, either with or without a β-2 microglobulin attached to the N-terminus by a flexible linker. Examples of such linkers include those provided in SEQ ID NOs:43-166, 244, 307, 320, 355-379 and 383-398 and described below. The preparation of soluble HLA-G1 is described in US Patent Publication no. US 2004/0044182.

In yet other embodiments, the HLA-G agonist binding domain is an immunoglobulin variable binding domain, or a derivative thereof (e.g., an antibody, Fab, scFv, or the like) that specifically binds to ILT2, ILT4 or KIR2DL4. Antibodies that are specific for ILT2, ILT4 or KIR2DL4 include, for example, those described in US Patent Publication no. US 2003/0232051.

Human leukocyte antigen G (HLA-G) is a nonclassical major histocompatibility complex (MHC) class I molecule that is a heterodimer consisting of a heavy chain and a light chain (beta-2 microglobulin), with the heavy chain being anchored in the membrane. HLA-G functions as an immunomodulatory molecule that protects fetal tissues from the maternal immune system. While constitutive expression of HLA-G is limited to fetal tissues, adult thymic medulla, cornea, pancreatic islets and erythroid and endothelial cell precursors, its expression can be induced in cancers, transplantation, multiple sclerosis, inflammatory diseases and viral infections. The HLA-G primary transcript generates seven alternative mRNAs that encode the membrane-bound protein isoforms HLA-G1, -G2, -G3 and -G4, and the soluble protein isoforms HLA-G5, HLA-G6 and HLA-G7, with HLA-G5 being the soluble form of the cell surface-bound HLA-G1 protein.

While HLA-G does not seem to have significant immune stimulatory functions, it has been shown to bind to inhibitory receptors, namely ILT2, ILT4, KIR2DL4 and CD8, and thereby interact with B-cells, T-cells, NK cells and antigen-presenting cells. Dimeric forms of HLA-G have an affinity for ILT2 that is several orders of magnitude greater than the affinity for ILT4, KIR2DL4 or CD8. HLA-G1 has been shown to inhibit the cytolytic function of uterine and peripheral blood NK cells, the antigen-specific cytolytic function of cytotoxic T lymphocytes, the alloproliferative response of CD4+ T-cells, the proliferation of T-cells and peripheral blood NK cells, and the maturation and function of dendritic cells (see, for example, Wiendl et al. (2003) Blood, 126: 176-185). It has been suggested that HLA-G may be useful in reducing inflammatory responses in the CNS associated with multiple sclerosis (Wiendl et al. (2005) Blood, 128: 2689-2704), and as a therapeutic agent in promoting tolerance to grafts in transplantations (Carosella et al. (2008) Blood 111:4862-4870).

In some embodiments, binding domains of this disclosure comprise $V_L$ and $V_H$ domains specific for a ILT2, ILT4 or KIR2DL4 as described herein. In certain embodiments, the $V_L$ and $V_H$ domains are human. The $V_L$ and $V_H$ domains may be arranged in either orientation and may be separated by up to about a 30 amino acid linker as disclosed herein or any other amino acid sequence capable of providing a spacer function compatible with interaction of the two sub-binding domains. In certain embodiments, a linker joining the $V_L$ and $V_H$ domains comprises an amino acid sequence as set forth in any one or more of SEQ ID NOs:43-166, 244, 307, 320, 355-379 and 383-398, such as Linker 115 (SEQ ID NO:148), the linker provided in SEQ ID NO:244, Linker 46 (SEQ ID NO:88), Linker 130 (SEQ ID NO:163), or Linker 131 (SEQ ID NO:164). Multi-specific binding domains can have at least two specific sub-binding domains, by analogy to camelid antibody organization, or at least four specific sub-binding domains, by analogy to the more conventional mammalian antibody organization of paired $V_L$ and $V_H$ chains.

In further embodiments, binding domains specific for ILT2, ILT4 or KIR2DL4 of this disclosure may comprise one or more complementarity determining region ("CDR"), or multiple copies of one or more such CDRs, which have been obtained, derived, or designed from variable regions of an anti-ILT2, -ILT4 or -KIR2DL4 scFv or Fab fragment or from heavy or light chain variable regions thereof. Thus, a binding domain of this disclosure can comprise a single CDR from a variable region of an anti-ILT2, -ILT4 or -KIR2DL4, or it can comprise multiple CDRs that can be the same or different.

HGF

As noted above, in certain embodiments the present disclosure provides polypeptides containing a binding region or domain that is an HGF agonist (i.e., can increase HGF signaling). In some embodiments, the HGF agonist binding domain is an HGF or a functional sub-domain thereof.

Hepatocyte growth factor (HGF) regulates cell growth, cell motility, and morphogenesis by activating a tyrosine kinase signaling cascade after binding to the proto-oncogenic c-Met receptor. HGF influences a number of cell types and regulates various biological activities including cytokine production, cell migration, proliferation and survival. HGF is secreted as a single inactive polypeptide and is cleaved by serine proteases into a 69-kDa alpha-chain and 34-kDa beta-chain. A disulfide bond between the alpha and beta chains produces the active, heterodimeric molecule. Alternative splicing of the HGF gene gives rise to five different isoforms (isoforms 1-5; GenBank™ Accessions nos. NP_000592.3, NP_001010931.1, NP_001010932.1, NP_001010933.1 and NP_001010934.1, respectively; SEQ ID NOs: 18-22; amino acids 1-31 of each of these sequences is the signal peptide).

HGF is believed to be a key factor in the prevention and attenuation of disease progression (Ito et al. (2008) Int. Arch. Allergy Immunol. 146 Suppl 1:82-87). For example, HGF has been shown to be effective in suppressing collagen-induced arthritis in mice (Okunishi et al. (2007) Jnl. Immunol. 179:5504-5513), and to play a protective role in a mouse model of allergic airway inflammation (Okunishi et al. (2005) Jnl. Immunol. 175:4745-4753; Ito et al. Am. J. Respir. Cell. Mol. Biol. (2005) 32:268-280).

In some embodiments, binding domains of this disclosure comprise $V_L$ and $V_H$ domains specific for HGF as described herein. In certain embodiments, the $V_L$ and $V_H$ domains are human. The $V_L$ and $V_H$ domains may be arranged in either orientation and may be separated by up to about a 30 amino acid linker as disclosed herein or any other amino acid sequence capable of providing a spacer function compatible with interaction of the two sub-binding domains. In certain embodiments, a linker joining the $V_L$ and $V_H$ domains comprises an amino acid sequence as set forth in any one or more of SEQ ID NOs:43-166, 244, 307, 320, 355-379 and 383-398, such as the linker provided in SEQ ID NO:244, Linker 46 (SEQ ID NO:88), Linker 130 (SEQ ID NO:163), or Linker 131 (SEQ ID NO:164). Multi-specific binding domains can have at least two specific sub-binding domains, by analogy to camelid antibody organization, or at least four specific sub-binding domains, by analogy to the more conventional mammalian antibody organization of paired $V_L$ and $V_H$ chains. In further embodiments, binding domains specific for HGF of this disclosure may comprise one or more complementarity determining region ("CDR"), or multiple copies of one or more such CDRs, which have been obtained, derived, or designed from variable regions of an anti-HGF scFv or Fab fragment or from heavy or light chain variable regions thereof. Thus, a binding domain of this disclosure can comprise a single CDR from a variable region of an anti-HGF, or it can comprise multiple CDRs that can be the same or different. In certain embodiments, binding domains of this disclosure comprise $V_L$ and $V_H$ domains specific for an HGF comprising framework regions and CDR1, CDR2 and CDR3 regions.

IL35

As noted above, in certain embodiments the present disclosure provides polypeptides containing a binding region or domain that is an IL35 agonist (i.e., can increase IL35 signaling). In some embodiments, the IL35 agonist binding domain is an IL35 (e.g. SEQ ID NO: 25 and 26) or a functional sub-domain thereof. In certain embodiments, the IL35 agonist binding domain is a single chain polypeptide comprising the sequences of SEQ ID NO: 25 and 26, or functional sub-domains thereof. Such single chain polypeptides may include one or more linkers, including linkers as described herein. In other embodiments, the IL35 agonist binding domain is a single chain immunoglobulin variable domain, such as a scFv, specific for IL35R that has IL35 agonist activity.

IL-35 is a newly described cytokine of the IL-12 cytokine subfamily. The heterodimeric molecule is comprised of the IL-12 p35 and the IL-27 Ebi3 subunits. It has recently been shown to be a potent inducer of Treg function and capable of altering a TH17 response in a mouse model of arthritis (Niedbala et al. (2007) Eur. J. Immunol. 37:3021; Collison et al. (2007) Nature 450:566). Therefore, combining IL-35 agonism with CD86 inhibition is predicted to increase the therapeutic benefit of CD28 inhibition alone.

Regulatory T-cells (TREGS) are a critical sub-population of CD4+ T cells that are important for maintaining self tolerance and preventing autoimmunity, for limiting chronic inflammatory diseases, such as asthma and inflammatory bowel disease, and for regulating homeostatic lymphocyte expansion. IL35 is an anti-inflammatory cytokine that has been shown to suppress immune responses by stimulating expansion of regulatory T cells and suppression of Th17 cell development (Collison et al. (2007) Nature 450:566-9). IL35 is a heterodimer formed from Epstein-Barr virus-induced gene 3 (EBI3; SEQ ID NO: 25; signal peptide: amino acids 1-20) and the p35subunit of IL12 (SEQ ID NO: 26; signal peptide: amino acids 1-56) (Devergne et al. (1997) Proc. Natl. Acad. Sci. USA 94:12041-12046; U.S. Pat. No. 5,830,451; US Patent Publication no. US 2007/0299026). It has been shown to have a therapeutic effect equivalent to that of Enbrel™ in a murine collagen-induced arthritis model (Niedbala et al. (2007) Eur. J. Immunol. 37:3021-3029), and has thus been proposed as a therapeutic agent against clinical rheumatoid arthritis.

In some embodiments, binding domains of this disclosure comprise $V_L$ and $V_H$ domains specific for an IL35R as described herein. In certain embodiments, the $V_L$ and $V_H$ domains are human. The $V_L$ and $V_H$ domains may be arranged in either orientation and may be separated by up to about a 30 amino acid linker as disclosed herein or any other amino acid sequence capable of providing a spacer function compatible with interaction of the two sub-binding domains. In certain embodiments, a linker joining the $V_L$ and $V_H$ domains comprises an amino acid sequence as set forth in any one or more of SEQ ID NOs:43-166, 244, 307, 320, 355-379 and 383-398, such as the linker provided in SEQ ID NO:244, Linker 46 (SEQ ID NO:88), Linker 130 (SEQ ID NO:163), or Linker 131 (SEQ ID NO:164). Multi-specific binding domains can have at least two specific sub-binding domains, by analogy to camelid antibody organization, or at least four specific sub-binding domains, by analogy to the more conventional mammalian antibody organization of paired $V_L$ and $V_H$ chains. In further embodiments, binding domains specific for IL35R of this disclosure may comprise one or more complementarity determining region ("CDR"), or multiple copies of one or more such CDRs, which have been obtained, derived, or designed from variable regions of an anti-IL35R scFv or Fab fragment or from heavy or light chain variable regions thereof. Thus, a binding domain of this disclosure can comprise a single CDR from a variable region of an anti-IL35R, or it can comprise multiple CDRs that can be the same or different. In certain embodiments, binding domains of this disclosure comprise $V_L$ and $V_H$ domains specific for an IL-35R comprising framework regions and CDR1, CDR2 and CDR3 regions.

Light

As noted above, in certain embodiments the present disclosure provides polypeptides containing a binding region or domain that is a LIGHT antagonist (i.e., can inhibit LIGHT signaling). In some embodiments, the LIGHT antagonist binding domain is an HVEM ectodomain (also referred to as sHVEM; SEQ ID NO: 29; signal peptide: amino acids 1-38) or a functional sub-domain thereof. In other embodiments, the LIGHT antagonist binding domain is a single chain immunoglobulin-like variable domain, such as a scFv, specific for LIGHT. In certain embodiments, the LIGHT antagonist domain is a single chain immunoglobulin-like variable domain comprising $V_H$ and $V_L$ domains as described in PCT Patent Publication no. WO 08/027,338.

LIGHT is a member of the TNF superfamily that is expressed on activated T lymphocytes, monocytes, granulocytes and immature dendritic cells. Two distinct isoforms of LIGHT have been reported (GenBank™ Accession nos. NP_003798.2 and NP_742011.1). LIGHT has been shown to regulate T cell immune responses by signaling through the herpes virus entry mediator (HVEM) and the lymphotoxin beta receptor (LTβR). Both HVEM and LTβR bind LIGHT with high affinity, with expression of HVEM being detected in T cells, B cells, natural killer cells and endothelial cells, and LTβR being expressed in monocytes and stromal cells but not T cells and B cells. LIGHT has been shown to be a co-stimulatory molecule for CD28-independent T cell activation and to preferentially induce IFN-γ and GM-CSF production. Blockade of LIGHT by in vivo administration of LTβR-Ig fusion protein or anti-LIGHT antibodies results in decreased T cell-mediated immune responses and ameliorates graft-versus-host disease in a murine model (Tamada et al. (2000) Nat. Med. 6:283-9). Constitutive expression of LIGHT leads to tissue destruction and autoimmune-like disease syndromes (Granger & Rickert (2003) Cytokine Growth Factor Rev. 14:289-96).

In some embodiments, binding domains of this disclosure comprise $V_L$ and $V_H$ domains specific for LIGHT as described herein. In certain embodiments, the $V_L$ and $V_H$ domains are human. The $V_L$ and $V_H$ domains may be arranged in either orientation and may be separated by up to about a 30 amino acid linker as disclosed herein or any other amino acid sequence capable of providing a spacer function compatible with interaction of the two sub-binding domains. In certain embodiments, a linker joining the $V_L$ and $V_H$ domains comprises an amino acid sequence as set forth in any one or more of SEQ ID NOs:43-166, 244, 307, 320, 355-379 and 383-398, such as the linker provided in SEQ ID NO:244, Linker 46 (SEQ ID NO:88), Linker 130 (SEQ ID NO:163), or Linker 131 (SEQ ID NO:164). Multi-specific binding domains can have at least two specific sub-binding domains, by analogy to camelid antibody organization, or at least four specific sub-binding domains, by analogy to the more conventional mammalian antibody organization of paired $V_L$ and $V_H$ chains.

In further embodiments, binding domains specific for LIGHT of this disclosure may comprise one or more complementarity determining region ("CDR"), or multiple copies of one or more such CDRs, which have been obtained, derived, or designed from variable regions of an anti-LIGHT scFv or Fab fragment or from heavy or light chain variable regions thereof. Thus, a binding domain of this disclosure can comprise a single CDR from a variable region of an anti-LIGHT, or it can comprise multiple CDRs that can be the same or different. In certain embodiments, binding domains of this disclosure comprise $V_L$ and $V_H$ domains specific for a LIGHT comprising framework regions and CDR1, CDR2 and CDR3 regions.

PD-1

As noted above, in certain embodiments the present disclosure provides polypeptides containing a binding region or domain that is a PD-1 agonist (i.e., can increase PD-1 signaling). In some embodiments, the PD-1 agonist binding domain is a PD1-L1 (e.g. SEQ ID NO: 32; signal peptide: amino acids 1-18), a PD1-L2 (e.g. SEQ ID NO: 33; signal peptide: amino acids 1-19), or a functional sub-domain thereof. In other embodiments, the PD-1 agonist binding domain is a single chain immunoglobulin-like variable domain, such as a scFv, specific for PD-1. Antibodies specific for PD-1 include, for example, those described in US Patent Publication No. US 2006/0210567.

PD-1 (GenBank™ Accession NP 005009.1) is a member of the CD28/CTLA4 family that is expressed on activated T cells, B cells and myeloid cells. PD-1 contains an immunoreceptor tyrosine-based inhibitory motif. PD-1 functions by binding to programmed death-1 ligand 1 (PD1-L1; also known as CD274) and programmed death-1 ligand 2 (PD1-L2). Human PD-L1 and PD-L2 are expressed on both immature and mature dendritic cells, IFN-treated monocytes and follicular dendritic cells. Mice deficient in PD-1 show a variety of autoimmune pathologies, demonstrating that PD-1 is a negative regulator of the immune response (Nishimura & Honjo (2001) Trends Immunol. 2:265; Nishimura et al. (1999) Immunity 11:141). Binding of PD-1 to PD1-L1 and PD1-L2 has been shown to result in down-regulation of T cell activation (Freeman et al. (2000) J. Exp. Med. 192: 1027; Latchman et al. (2001) Nat. Immunol. 2:261; Carter et al. (2002) Eur. J. Immunol. 32:634).

In some embodiments, binding domains of this disclosure comprise $V_L$ and $V_H$ domains specific for a PD-1 as described herein. In certain embodiments, the $V_L$ and $V_H$ domains are human. The $V_L$ and $V_H$ domains may be arranged in either orientation and may be separated by up to about a 30 amino acid linker as disclosed herein or any other amino acid sequence capable of providing a spacer function compatible with interaction of the two sub-binding domains. In certain embodiments, a linker joining the $V_L$ and $V_H$ domains comprises an amino acid sequence as set forth in SEQ ID NOs:43-166, 244, 307, 320, 355-379 and 383-398, such as the linker provided in SEQ ID NO:244, Linker 46 (SEQ ID NO:88), Linker 130 (SEQ ID NO:163), or Linker 131 (SEQ ID NO:164). Multi-specific binding domains can have at least two specific sub-binding domains, by analogy to camelid antibody organization, or at least four specific sub-binding domains, by analogy to the more conventional mammalian antibody organization of paired $V_L$ and $V_H$ chains.

In further embodiments, binding domains specific for PD-1 of this disclosure may comprise one or more complementarity determining region ("CDR"), or multiple copies of one or more such CDRs, which have been obtained, derived, or designed from variable regions of an anti-PD-1 scFv or Fab fragment or from heavy or light chain variable regions thereof. Thus, a binding domain of this disclosure can comprise a single CDR from a variable region of an anti-PD-1, or it can comprise multiple CDRs that can be the same or different.

BTLA

As noted above, in certain embodiments the present disclosure provides polypeptides containing a binding region or domain that is a BTLA agonist (i.e., can increase BTLA signaling). In some embodiments, the BTLA agonist binding domain is a HVEM ectodomain (also referred to as sHVEM; SEQ ID NO: 29; signal peptide: amino acids 1-38) or a functional sub-domain thereof (e.g. amino acids 54-78 of SEQ ID NO: 29). In other embodiments, the BTLA agonist binding domain is a single chain immunoglobulin-like variable domain, such as a scFv, specific for BTLA. Agonist antibodies specific for BTLA are described, for example, in Krieg et al. (2005) J. Immunol. 175:6420-6472.

BTLA (GenBank™ Accession nos. NP_001078826.1 and NP_861445.3; isoforms 2 and 1, respectively) is a cell surface protein that is a member of the immunoglobulin family and is expressed on B-cells, T-cells and antigen presenting cells. The ligand for BTLA is herpes virus entry mediator (HVEM), which is a member of the tumor-necrosis factor receptor family and also acts as a ligand for LIGHT (Sedy et al. (2005) Nat. Immunol. 6:90-98). A binding site for BTLA has been identified in CRD1 of HVEM (amino acids 54-78 of SEQ ID NO: 29; PCT Patent Publication no. WO 2006/063067). This site is distinct from that occupied by LIGHT but overlaps the gD binding site of HVEM. While binding of HVEM to LIGHT induces a strong immune response, binding of HVEM to BTLA results in negative regulation of T cell responses (Murphy et al. (2006) Nat. Rev. Immunol. 6:671-681). It has been indicated that binding of BTLA to HVEM activates tyrosine phosphorylation of BTLA thereby inducing association with the protein tyrosine phosphatases SHP-1 and SHP-2 (Gavrieli et al. (2003) Biochem. Biophys. Res. Commun. 312:1236), although some data question whether SHP recruitment is responsible for the negative regulatory activity of BTLA (Chemnitz et al. (2006) J. Immunol. 176:6603-6614).

Soluble HVEM has been shown to inhibit anti-CD3-induced proliferation of CD4+ T cells, with this effect being reversed by anti-BTLA antibodies (Gonzalez et al. (2005) Proc. Natl. Acad. Sci. USA 102:1116-1121). Similarly, an agonistic anti-BTLA monoclonal antibody was shown to inhibit anti-CD3-mediated CD4+ T-cell proliferation and cytokine production (Krieg et al. (2005) J. Immunol. 175: 6420-6472). Mice lacking an intact BTLA gene show an increased sensitivity to experimental autoimmune encephalomyelitis, (Watanabe et al. (2003) Nat. Immunol. 4:670-679) and prolonged airway inflammation (Deppong et al. (2006) J. Immunol. 176:3909-3913).

In some embodiments, binding domains of this disclosure comprise $V_L$ and $V_H$ domains specific for a BTLA as described herein. In certain embodiments, the $V_L$ and $V_H$ domains are human. The $V_L$ and $V_H$ domains may be arranged in either orientation and may be separated by up to about a 30 amino acid linker as disclosed herein or any other amino acid sequence capable of providing a spacer function compatible with interaction of the two sub-binding domains. In certain embodiments, a linker joining the $V_L$ and $V_H$ domains comprises an amino acid sequence as set forth in SEQ ID NOs:43-166, 244, 307, 320, 355-379 and 383-398, such as the linker provided in SEQ ID NO:244, Linker 46 (SEQ ID NO:88), Linker 130 (SEQ ID NO:163), or Linker 131 (SEQ ID NO:164). Multi-specific binding domains can have at least two specific sub-binding domains, by analogy to camelid antibody organization, or at least four specific sub-binding domains, by analogy to the more conventional mammalian antibody organization of paired $V_L$ and $V_H$ chains.

In further embodiments, binding domains specific for BTLA of this disclosure may comprise one or more complementarity determining region ("CDR"), or multiple copies of one or more such CDRs, which have been obtained, derived, or designed from variable regions of an anti-BTLA scFv or Fab fragment or from heavy or light chain variable regions thereof. Thus, a binding domain of this disclosure can comprise a single CDR from a variable region of an anti-BTLA, or it can comprise multiple CDRs that can be the same or different.

GITRL

As noted above, in certain embodiments the present disclosure provides polypeptides containing a binding region or domain that is a GITRL antagonist (i.e., can inhibit GITRL signaling). In some embodiments, the GITRL antagonist binding domain is a GITR ectodomain (also referred to as sGITR; SEQ ID NO: 39 and 40; signal peptides: amino acids 1-25 for each of these sequences) or a functional sub-domain thereof. In other embodiments, the GITRL antagonist binding domain is a single chain immunoglobulin-like variable domain, such as a scFv, specific for GITRL. Antagonistic antibodies against GITRL are described, for example, in US Patent Publication No. 2005/0014224.

Glucocorticoid-induced tumor necrosis factor receptor (GITR; also known as AITR), a type I transmembrane protein, is a member of the TNF receptor superfamily (Nocentini et al. (2007) Eur. J. Immunol. 37:1165-69). GITR plays an important role in the regulation of T cell proliferation and TCR-mediated apoptosis. GITR expression is upregulated on T cells, with a high level of GITR being constitutive expressed on $CD4^+CD25^+$ regulatory T cells (Kwon et al. (2003) Exp. Mol. Med. 35:8-16), with expression also occurring on macrophages, B cells and NK cells (Liu et al. (2008) J. Biol. Chem. 283:8202-8210). GITR's cognate ligand, GITRL is constitutively expressed on antigen-presenting cells, such as dendritic cells and B cells. Binding of GITR to GITRL has been shown to render $CD4^+CD25^-$ effector T cells resistant to the inhibitory effects of $CD4^+CD25^+$ regulatory T cells. GITR activation by either GITRL or an agonistic antibody has been shown to increase TCR-induced T cell proliferation and cytokine production, and to rescue T cells from anti-CD3-induced apoptosis (Nocentini et al. (1997) Proc. Natl. Acad. Sci. USA 94:6216-6221). In addition, binding of GITR to GITRL can inhibit T regulatory cells and/or render effector T cells more resistant to T regulatory cell-mediated suppression (Kanamaru et al. (2004) J. Immunol. 172:7306-7314).

Studies have shown that administration of anti-GITR mAb during the induction phase of experimental autoimmune encephalomyelitis significantly enhances the severity of clinical disease as well as increasing CNS inflammation and autoreactive T cell responses (Kohm et al. (2004) J. Immunol. 172:4686-4690). In addition, activation of GITR signaling exacerbates both murine asthma and collagen-induced arthritis (Patel et al. (2005) Eur. J., Immunol. 35:3581-90).

In some embodiments, binding domains of this disclosure comprise $V_L$ and $V_H$ domains specific for GITRL as described herein. In certain embodiments, the $V_L$ and $V_H$ domains are human. The $V_L$ and $V_H$ domains may be arranged in either orientation and may be separated by up to about a 30 amino acid linker as disclosed herein or any other amino acid sequence capable of providing a spacer function compatible with interaction of the two sub-binding domains. In certain embodiments, a linker joining the $V_L$ and $V_H$ domains comprises an amino acid sequence as set forth in SEQ ID NOs:43-166, 244, 307, 320, 355-379 and 383-398, such as the linker provided in SEQ ID NO:244, Linker 46 (SEQ ID NO:88), Linker 130 (SEQ ID NO:163), or Linker 131 (SEQ ID NO:164). Multi-specific binding domains can have at least two specific sub-binding domains, by analogy to camelid antibody organization, or at least four specific sub-binding domains, by analogy to the more conventional mammalian antibody organization of paired $V_L$ and $V_H$ chains.

In further embodiments, binding domains specific for GITRL of this disclosure may comprise one or more complementarity determining region ("CDR"), or multiple copies of one or more such CDRs, which have been obtained, derived, or designed from variable regions of an anti-GITRL scFv or Fab fragment or from heavy or light chain variable regions thereof. Thus, a binding domain of this disclosure can comprise a single CDR from a variable region of an anti-GITRL, or it can comprise multiple CDRs that can be the same or different. In certain embodiments, binding domains of this disclosure comprise $V_L$ and $V_H$ domains specific for a GITRL comprising framework regions and CDR1, CDR2 and CDR3 regions.

CD40

As noted above, in certain embodiments the present disclosure provides polypeptides containing a binding region or domain that is a CD40 antagonist (i.e., can inhibit CD40 signaling). In some embodiments, the CD40 antagonist binding domain is a single chain immunoglobulin-like variable domain, such as a scFv, specific for CD40. Antagonistic antibodies against CD40 are described, for example in US Patent Publication no. US 2008/0057070, and U.S. Pat. Nos. 5,874,082 and 6,838,261.

CD40 is a 55 kDa cell-surface antigen found on the surface of normal and neoplastic B cells, dendritic cells, antigen presenting cells, endothelial cells, monocytic cells and epithelial cells. CD40 expression on antigen presenting cells plays an important co-stimulatory role in the action of T-helper and cytotoxic T lymphocytes. Expression of the CD40 ligand (CD40L, also known as CD154) is upregulated on T cells during a normal immune response. Binding of T cell expressed CD40L to B cell expressed CD40 leads to B cell proliferation and differentiation, antibody production, isotype switching and B-cell memory generation. A human anti-CD40 antagonistic antibody has been shown to have antileukemia activity on human chronic lymphocytic leukemia cells (Luqman et al. (2008) Blood 112:711-720).

In some embodiments, binding domains of this disclosure comprise $V_L$ and $V_H$ domains specific for CD40 as described, for example, in US Patent Publication no. US 2008/0057070. In certain embodiments, the $V_L$ and $V_H$ domains are human. The $V_L$ and $V_H$ domains may be arranged in either orientation and may be separated by up to about a 30 amino acid linker as disclosed herein or any other amino acid sequence capable of providing a spacer function compatible with interaction of the two sub-binding domains. In certain embodiments, a linker joining the $V_L$ and $V_H$ domains comprises an amino acid sequence as set forth in SEQ ID NOs:43-166, 244, 307, 320, 355-379 and 383-398, such as the linker provided in SEQ ID NO:244, Linker 46 (SEQ ID NO:88), Linker 130 (SEQ ID NO:163), or Linker 131 (SEQ ID NO:164). Multi-specific binding domains can have at least two specific sub-binding domains, by analogy to camelid antibody organization, or at least four specific sub-binding domains, by analogy to the more conventional mammalian antibody organization of paired $V_L$ and $V_H$ chains.

In further embodiments, binding domains specific for CD40 of this disclosure may comprise one or more complementarity determining region ("CDR"), or multiple copies of one or more such CDRs, which have been obtained, derived, or designed from variable regions of an anti-CD40 scFv or Fab fragment or from heavy or light chain variable regions thereof. Thus, a binding domain of this disclosure can comprise a single CDR from a variable region of an anti-CD40, or it can comprise multiple CDRs that can be the same or different. In certain embodiments, binding domains of this disclosure comprise $V_L$ and $V_H$ domains specific for a CD40 comprising framework regions and CDR1, CDR2 and CDR3 regions as described, for example, in US Patent Publication no. US 2008/0057070.

Multi-Specific Fusion Proteins

The present disclosure provides multi-specific fusion proteins comprising a domain that binds to a CD86 ("CD86 binding domain") and a domain that binds a molecule other than a CD86 ("heterologous binding domain"). In certain embodiments, the heterologous binding domain is an IL-10 agonist, an HLA-G agonist, an HGF agonist, an IL-35 agonist, a PD-1 agonist, a BTLA agonist, a LIGHT antagonist, a GITRL antagonist or a CD40 antagonist.

In certain embodiments, the heterologous binding domain is an IL10 agonist, such as IL10, IL10Fc or a single chain binding domain that specifically binds to IL10R1 or IL10R2. In certain embodiments, the heterologous binding domain is an HLA-G agonist, such as an HLA-G1, an HLA-G5, an HLA-G mutein, or a functional region thereof (such as an ectodomain), or a single chain binding domain that specifically binds to ILT2, ILT4 or KIR2DL4. In certain embodiments, the heterologous binding domain is an HGF agonist, such as an HGF or a sub-domain thereof. In certain embodiments, the heterologous binding domain is an IL35 agonist, such as an IL35 or a sub-domain thereof, a single chain IL35 or subdomain thereof, or a single chain immunoglobulin-like variable domain specific for IL35R and having IL35 agonist activity. In certain embodiments, the heterologous binding domain is a LIGHT antagonist, such as a HVEM ectodomain or a sub-domain thereof, or a single chain immunoglobulin-like variable domain specific for LIGHT. In certain embodiments, the heterologous binding domain is a PD-1 agonist, such as a PD1-L1, PD1-L2 or a sub-domain thereof, or a single chain immunoglobulin-like variable domain specific for PD-1. In certain embodiments, the heterologous binding domain is a BTLA agonist, such as a HVEM ectodomain or a sub-domain thereof, or a single chain immunoglobulin-like variable domain specific for BTLA. In certain embodiments, the heterologous binding domain is a GITRL antagonist, such as a GITR ectodomain or a sub-domain thereof, or a single chain immunoglobulin-like variable domain specific for GITRL. In certain embodiments, the heterologous binding domain is a CD40 antagonist, such as a single chain immunoglobulin-like variable domain specific for CD40.

Generally, the fusion proteins of the present invention make use of mature proteins that do not include the leader peptide (signal peptide). Accordingly, while certain sequences provided herein for binding domain proteins (such as for CTLA4, CD28, HLA-G1 and HLA-G5 and others described herein) include the leader peptide, the skilled person would readily understand how to determine the mature protein sequence from sequences including a signal peptide. In certain embodiments, it may be useful to include the leader sequence.

It is contemplated that a CD86 binding domain may be at the amino-terminus and the heterologous binding domain at the carboxy-terminus of a fusion protein. In certain embodiments, the xceptor molecule is as set forth in SEQ ID NO:9, 13, 17, 24, 28, 31, 35, 42, 171, 173, 175, 177, 179, 181, 187, 189, 191, 193, 219, 221, 223, 237, 262, 302, 330, 336, 338, 340, or 400. It is also contemplated that the heterologous binding domain may be at the amino-terminus and the CD86 binding domain may be at the carboxy-terminus. In certain embodiments, the xceptor molecule is as set forth in SEQ ID NO:183, 185, 199, 201, 203, 205, 207, 211, 213, 254, 258, 266, 276, 350, 352, or 354. As set forth herein, the binding domains of this disclosure may be fused to each end of an intervening domain (e.g., an immunoglobulin constant region or sub-region thereof). Furthermore, the two or more binding domains may be each joined to an intervening domain via a linker, as described herein.

As used herein, an "intervening domain" refers to an amino acid sequence that simply functions as a scaffold for one or more binding domains so that the fusion protein will exist primarily (e.g., 50% or more of a population of fusion proteins) or substantially (e.g., 90% or more of a population of fusion proteins) as a single chain polypeptide in a composition. For example, certain intervening domains can have a structural function (e.g., spacing, flexibility, rigidity) or biological function (e.g., an increased half-life in plasma, such as in human blood). Exemplary intervening domains that can increase half-life of the fusion proteins of this disclosure in plasma include albumin, transferrin, a scaffold domain that binds a serum protein, or the like, or fragments thereof.

In certain embodiments, the intervening domain contained in a multi-specific fusion protein of this disclosure is a "dimerization domain," which refers to an amino acid sequence that is capable of promoting the association of at least two single chain polypeptides or proteins via non-covalent or covalent interactions, such as by hydrogen bonding, electrostatic interactions, Van der Waal's forces, disulfide bonds, hydrophobic interactions, or the like, or any combination thereof. Exemplary dimerization domains include immunoglobulin heavy chain constant regions or sub-regions. It should be understood that a dimerization domain can promote the formation of dimers or higher order multimer complexes (such as trimers, tetramers, pentamers, hexamers, septamers, octamers, etc.).

A "constant sub-region" is a term defined herein to refer to a peptide, polypeptide, or protein sequence that corresponds to or is derived from part or all of one or more constant region domains, but not all constant region domains of a source antibody. In a preferred embodiment, the constant sub-region is an IgG CH2CH3, preferably an IgG1 CH2CH3. In some embodiments, the constant region domains of a fusion protein of this disclosure may lack or have minimal effector functions of antibody-dependent cell-mediated cytotoxicity (ADCC) and complement activation and complement-dependent cytotoxicity (CDC), while retaining the ability to bind some $F_c$ receptors (such as $F_cRn$ binding) and retaining a relatively long half life in vivo. In certain embodiments, a binding domain of this disclosure is fused to a human IgG1 constant region or sub-region, wherein the IgG1 constant region or sub-region has one or more of the following amino acids mutated: leucine at position 234 (L234), leucine at position 235 (L235), glycine at position 237 (G237), glutamate at position 318 (E318), lysine at position 320 (K320), lysine at position 322 (K322), or any combination thereof (numbering according to Kabat). For example, any one or more of these amino acids can be changed to alanine. In a further embodiment, an IgG1 Fc domain has each of L234, L235, G237, E318, K320, and K322 (according to EU numbering) mutated to an alanine (i.e., L234A, L235A, G237A, E318A, K320A, and K322A, respectively), and optionally an N297A mutation as well (i.e., essentially eliminating glycosylation of the CH2 domain).

Methods are known in the art for making mutations inside or outside an Fc domain that can alter Fc interactions with Fc receptors (CD16, CD32, CD64, CD89, FcεR1, FcRn) or with the complement component C1q (see, e.g., U.S. Pat. No. 5,624,821; Presta (2002) Curr. Pharma. Biotechnol. 3:237). Particular embodiments of this disclosure include compositions comprising immunoglobulin or fusion proteins that have a constant region or sub-region from human IgG wherein binding to FcRn and protein A are preserved and wherein the Fc domain no longer interacts or minimally interacts with other Fc receptors or C1q. For example, a binding domain of this disclosure can be fused to a human IgG1 constant region or sub-region wherein the asparagine at position 297 (N297 under the Kabat numbering) has been mutated to another amino acid to reduce or eliminate glycosylation at this site and, therefore, abrogate efficient Fc binding to FcγR and C1q. Another exemplary mutation is a P331S, which diminishes C1q binding but does not affect Fc binding.

In further embodiments, an immunoglobulin Fc region may have an altered glycosylation pattern relative to an immunoglobulin reference sequence. For example, any of a variety of genetic techniques may be employed to alter one or more particular amino acid residues that form a glycosylation site (see Co et al. (1993) Mol. Immunol. 30:1361; Jacquemon et al. (2006) J. Thromb. Haemost. 4:1047; Schuster et al. (2005) Cancer Res. 65:7934; Warnock et al. (2005) Biotechnol. Bioeng. 92:831), such as N297 of the CH2 domain (EU numbering). Alternatively, the host cells producing fusion proteins of this disclosure may be engineered to produce an altered glycosylation pattern. One method known in the art, for example, provides altered glycosylation in the form of bisected, non-fucosylated variants that increase ADCC. The variants result from expression in a host cell containing an oligosaccharide-modifying enzyme. Alternatively, the Potelligent technology of BioWa/Kyowa Hakko is contemplated to reduce the fucose content of glycosylated molecules according to this disclosure. In one known method, a CHO host cell for recombinant immunoglobulin production is provided that modifies the glycosylation pattern of the immunoglobulin Fc region, through production of GDP-fucose.

Alternatively, chemical techniques are used to alter the glycosylation pattern of fusion proteins of this disclosure. For example, a variety of glycosidase and/or mannosidase inhibitors provide one or more of desired effects of increasing ADCC activity, increasing Fc receptor binding, and altering glycosylation pattern. In certain embodiments, cells expressing a multispecific fusion protein of the instant disclosure (containing a CD86 antagonist domain linked to an IL-10 agonist, an HLA-G agonist, an HGF agonist, an IL-35 agonist, a PD-1 agonist, a BTLA agonist, a LIGHT antagonist, a GITRL antagonist or a CD40 antagonist) are grown in a culture medium comprising a carbohydrate modifier at a concentration that increases the ADCC of immunoglycoprotein molecules produced by said host cell, wherein said carbohydrate modifier is at a concentration of less than 800 µM. In a preferred embodiment, the cells expressing these multispecific fusion proteins are grown in a culture medium comprising castanospermine or kifunensine, more preferably castanospermine at a concentration of 100-800 µM, such as 100 µM, 200 µM, 300 µM, 400 µM, 500 µM, 600 µM, 700 µM, or 800 µM. Methods for altering glycosylation with a carbohydrate modifier such as castanospermine are provided in US Patent Application Publication No. 2009/0041756 or PCT Publication No. WO 2008/052030.

In another embodiment, the immunoglobulin Fc region may have amino acid modifications that affect binding to effector cell Fc receptors. These modifications can be made using any technique known in the art, such as the approach disclosed in Presta et al. (2001) *Biochem. Soc. Trans.* 30:487. In another approach, the Xencor XmAb™ technology is available to engineer constant sub-regions corresponding to Fc domains to enhance cell killing effector function (see Lazar et al. (2006) Proc. Nat'l. Acad. Sci. (USA) 103:4005). Using this approach, for example, one can generate constant sub-regions with improved specificity and binding for FCγR, thereby enhancing cell killing effector function.

In still further embodiments, a constant region or sub-region can optionally increase plasma half-life or placental transfer in comparison to a corresponding fusion protein lacking such an intervening domain. In certain embodiments, the extended plasma half-life of a fusion protein of this disclosure is at least two, at least three, at least four, at least five, at least ten, at least 12, at least 18, at least 20, at least 24, at least 30, at least 36, at least 40, at least 48 hours, at least several days, at least a week, at least two weeks, at least several weeks, at least a month, at least two months, at least several months, or more in a human.

A constant sub-region may include part or all of any of the following domains: a $C_{H2}$ domain, a $C_{H3}$ domain (IgA, IgD, IgG, IgE, or IgM), and a $C_{H4}$ domain (IgE or IgM). A constant sub-region as defined herein, therefore, can refer to a polypeptide that corresponds to a portion of an immunoglobulin constant region. The constant sub-region may comprise a $C_{H2}$ domain and a $C_{H3}$ domain derived from the same, or different, immunoglobulins, antibody isotypes, or allelic variants. In some embodiments, the $C_{H3}$ domain is truncated and comprises a carboxy-terminal sequence listed in U.S. patent application Ser. No. 12/041,590 (which is a CIP of PCT/US2007/071052) as SEQ ID NOS:366-371. In certain embodiments, a constant sub-region of a polypeptide of this disclosure has a $C_{H2}$ domain and $C_{H3}$ domain, which may optionally have an amino-terminal linker, a carboxy-terminal linker, or a linker at both ends.

A "linker" is a peptide that joins or links other peptides or polypeptides, such as a linker of about 2 to about 150 amino acids. In fusion proteins of this disclosure, a linker can join an intervening domain (e.g., an immunoglobulin-derived constant sub-region) to a binding domain or a linker can join two variable regions of a binding domain, or two regions within a single chain polypeptide formed from a heterodimeric molecule, such as EBI3 (SEQ ID NO: 25) and the p35subunit of IL12 (SEQ ID NO: 26) of IL35. For example, a linker can be an amino acid sequence obtained, derived, or designed from an antibody hinge region sequence, a sequence linking a binding domain to a receptor, or a sequence linking a binding domain to a cell surface transmembrane region or membrane anchor. In some embodiments, a linker can have at least one cysteine capable of participating in at least one disulfide bond under physiological conditions or other standard peptide conditions (e.g., peptide purification conditions, conditions for peptide storage). In certain embodiments, a linker corresponding or similar to an immunoglobulin hinge peptide retains a cysteine that corresponds to the hinge cysteine disposed toward the amino-terminus of that hinge. In further embodiments, a linker is from an IgG1 or IgG2A hinge and has one cysteine or two cysteines corresponding to hinge cysteines. In certain embodiments, one or more disulfide bonds are formed as inter-chain disulfide bonds between intervening domains. In other embodiments, fusion proteins of this disclosure can have an intervening domain fused directly to a binding domain (i.e., absent a linker or hinge). In some embodiments, the intervening domain is a dimerization domain, such as an IgG1 CH2CH3 Fc portion.

The intervening or dimerization domain of multi-specific fusion proteins of this disclosure may be connected to one or more terminal binding domains by a peptide linker. In addition to providing a spacing function, a linker can provide flexibility or rigidity suitable for properly orienting the one or more binding domains of a fusion protein, both within the fusion protein and between or among the fusion proteins and their target(s). Further, a linker can support expression of a full-length fusion protein and stability of the purified protein both in vitro and in vivo following administration to a subject in need thereof, such as a human, and is preferably non-immunogenic or poorly immunogenic in those same subjects. In certain embodiments, a linker of an intervening or a dimerization domain of multi-specific fusion proteins of this disclosure may comprise part or all of a human immunoglobulin hinge.

Additionally, a binding domain may comprise a $V_H$ and a $V_L$ domain, and these variable region domains may be combined by a linker. Exemplary variable region binding domain linkers include those belonging to the $(Gly_nSer)$ family, such as $(Gly_3Ser)_n(Gly_4Ser)_1$, $(Gly_3Ser)_1(Gly_4Ser)_n$, $(Gly_3Ser)_n(Gly_4Ser)_n$, or $(Gly_4Ser)_n$, wherein n is an integer of 1 to 5 (see, e.g., Linkers 22, 29, 46, 89, 90, 116, 130, and 131 corresponding to SEQ ID NOS:64, 71, 88, 131, 132, 149, 163 and 164, respectively). In preferred embodiments, these $(Gly_4Ser)$-based linkers are used to link variable domains and are not used to link a binding domain (e.g., scFv) to an intervening domain (e.g., an IgG CH2CH3).

Exemplary linkers that can be used to join an intervening domain (e.g., an immunoglobulin-derived constant subregion) to a binding domain or a linker that can join two variable regions of a binding domain are listed in SEQ ID NOS:43-166, 244, 307, 320, 355-379 and 383-398.

Linkers contemplated in this disclosure include, for example, peptides derived from any inter-domain region of an immunoglobulin superfamily member (e.g., an antibody hinge region) or a stalk region of C-type lectins, a family of type II membrane proteins. These linkers range in length from about two to about 150 amino acids, or about two to about 40 amino acids, or about eight to about 20 amino acids, preferably about ten to about 60 amino acids, more preferably about 10 to about 30 amino acids, and most preferably about 15 to about 25 amino acids. For example, Linker 1 is two amino acids in length and Linker 116 is 36 amino acids in length (Linkers 1-133 are provided in SEQ ID NOS:43-166, respectively; additional exemplary linkers are provided in SEQ ID NOS:244, 307, 320, 355-379, and 383-398).

Beyond general length considerations, a linker suitable for use in the fusion proteins of this disclosure includes an antibody hinge region selected from an IgG hinge, IgA hinge, IgD hinge, IgE hinge, or variants thereof. In certain embodiments, a linker may be an antibody hinge region (upper and core region) selected from human IgG1, human IgG2, human IgG3, human IgG4, or fragments or variants thereof. As used herein, a linker that is an "immunoglobulin hinge region" refers to the amino acids found between the carboxyl end of CH1 and the amino terminal end of CH2 (for IgG, IgA, and IgD) or the amino terminal end of CH3 (for IgE and IgM). A "wild type immunoglobulin hinge region," as used herein, refers to a naturally occurring amino acid sequence interposed between and connecting the CH1 and CH2 regions (for IgG, IgA, and IgD) or interposed between and connecting the CH2 and CH3 regions (for IgE and IgM) found in the heavy chain of an antibody. In preferred embodiments, the wild type immunoglobulin hinge region sequences are human.

According to crystallographic studies, an IgG hinge domain can be functionally and structurally subdivided into three regions: the upper hinge region, the core or middle hinge region, and the lower hinge region (Shin et al. (1992) *Immunological Reviews* 130:87). Exemplary upper hinge regions include EPKSCDKTHT (SEQ ID NO:383) as found in IgG1, ERKCCVE (SEQ ID NO:384) as found in IgG2, ELKTPLGDTTHT (SEQ ID NO:385) or EPKSCDTPPP (SEQ ID NO:386) as found in IgG3, and ESKYGPP (SEQ ID NO:387) as found in IgG4. Exemplary middle hinge regions include CPPCP (SEQ ID NO:398) as found in IgG1 and IgG2, CPRCP (SEQ ID NO:388) as found in IgG3, and CPSCP (SEQ ID NO:389) as found in IgG4. While IgG1, IgG2, and IgG4 antibodies each appear to have a single upper and middle hinge, IgG3 has four in tandem—one of ELKTPLGDTTHTCPRCP (SEQ ID NO:390) and three of EPKSCDTPPPCPRCP (SEQ ID NO:391).

IgA and IgD antibodies appear to lack an IgG-like core region, and IgD appears to have two upper hinge regions in tandem (see SEQ ID NOS:392 and 393). Exemplary wild type upper hinge regions found in IgA1 and IgA2 antibodies are set forth in SEQ ID NOS: 394 and 395, respectively.

IgE and IgM antibodies, in contrast, instead of a typical hinge region have a CH2 region with hinge-like properties. Exemplary wild-type CH2 upper hinge-like sequences of IgE and IgM are set forth in SEQ ID NO:396 (VCSRDFTPPT VKILQSSSDG GGHFPPTIQL LCLVSGYTPG TINITWLEDG QVMDVDLSTA STTQEGELAS TQSELTLSQK HWLSDRTYTC QVTYQGHTFE DSTKKCA) and SEQ ID NO:397 (VIAELPPKVS VFVPPRDGFF GNPRKSKLIC QATGFSPRQI QVSWLREGKQ VGSGVTTDQV QAEAKESGPT TYKVTSTLTI KESDWLGQSM FTCRVDHRGL TFQQNASSMC VP), respectively.

An "altered wild type immunoglobulin hinge region" or "altered immunoglobulin hinge region" refers to (a) a wild type immunoglobulin hinge region with up to 30% amino acid changes (e.g., up to 25%, 20%, 15%, 10%, or 5% amino acid substitutions or deletions), (b) a portion of a wild type immunoglobulin hinge region that is at least 10 amino acids (e.g., at least 12, 13, 14 or 15 amino acids) in length with up to 30% amino acid changes (e.g., up to 25%, 20%, 15%, 10%, or 5% amino acid substitutions or deletions), or (c) a portion of a wild type immunoglobulin hinge region that comprises the core hinge region (which portion may be 4, 5, 6, 7, 8, 9, 10, 11, 12, 13, 14, or 15, or at least 4, 5, 6, 7, 8, 9, 10, 11, 12, 13, 14, or 15 amino acids in length). In certain embodiments, one or more cysteine residues in a wild type immunoglobulin hinge region may be substituted by one or more other amino acid residues (e.g., one or more serine residues). An altered immunoglobulin hinge region may alternatively or additionally have a proline residue of a wild type immunoglobulin hinge region substituted by another amino acid residue (e.g., a serine residue).

Alternative hinge and linker sequences that can be used as connecting regions may be crafted from portions of cell surface receptors that connect IgV-like or IgC-like domains. Regions between IgV-like domains where the cell surface receptor contains multiple IgV-like domains in tandem and between IgC-like domains where the cell surface receptor contains multiple tandem IgC-like regions could also be used as connecting regions or linker peptides. In certain embodiments, hinge and linker sequences are from five to 60 amino acids long, and may be primarily flexible, but may also provide more rigid characteristics, and may contain primarily an α-helical structure with minimal β-sheet structure. Preferably, sequences are stable in plasma and serum and are resistant to proteolytic cleavage. In some embodiments, sequences may contain a naturally occurring or added motif such as CPPC (SEQ ID NO:422) that confers the capacity to form a disulfide bond or multiple disulfide bonds to stabilize the C-terminus of the molecule. In other embodiments, sequences may contain one or more glycosylation sites. Examples of hinge and linker sequences include interdomain regions between the IgV-like and IgC-like or between the IgC-like or IgV-like domains of CD2, CD4, CD22, CD33, CD48, CD58, CD66, CD80, CD86, CD96, CD150, CD166, and CD244. Alternative hinges may also be crafted from disulfide-containing regions of Type II receptors from non-immunoglobulin superfamily members such as CD69, CD72, and CD161.

In certain embodiments, a linker of the present invention comprises a scorpion linker. Scorpion linkers include peptides derived from interdomain regions of an immunoglobulin superfamily member, e.g., hinge-like peptides derived from immunoglobulin hinge regions, such as IgG1, IgG2, IgG3, IgG4, IgA, and IgE hinge regions. In certain embodiments, a hinge-like scorpion linker will retain at least one cysteine capable of forming an interchain disulfide bond under physiological conditions. Scorpion linkers derived from IgG1 may have 1 cysteine or two cysteines, and may retain the cysteine corresponding to an N-terminal hinge cysteine of wild-type IgG1. Non-hinge-like peptides are also contemplated as scorpion linkers, provided that such peptides provide sufficient spacing and flexibility to provide a single-chain protein capable of forming two binding domains, one located towards each protein terminus (N and C) relative to a more centrally located constant sub-region domain. Exemplary non-hinge-like scorpion linkers include peptides from the stalk region of C-type lectin stalk regions of Type II membrane proteins, such as the stalk regions of CD69, CD72, CD94, NKG2A and NKG2D. In some embodiments, the scorpion linker comprises a sequence selected from the group consisting of SEQ ID NOs:355-359 and 365.

In some embodiments, a linker has a single cysteine residue for formation of an interchain disulfide bond. In other embodiments, a linker has two cysteine residues for formation of interchain disulfide bonds. In further embodiments, a linker is derived from an immunoglobulin interdomain region (e.g., an antibody hinge region) or a Type II C-type lectin stalk region (derived from a Type II membrane protein; see, e.g., exemplary lectin stalk region sequences set forth in of PCT Application Publication No. WO 2007/146968, such as SEQ ID NOS:111, 113, 115, 117, 119, 121, 123, 125, 127, 129, 131, 133, 135, 149, 151, 153, 155, 157, 159, 161, 163, 165, 167, 169, 231, 233, 235, 237, 239, 241, 243, 245, 247, 249, 251, 253, 255, 257, 259, 261, 263, 265, 267, 269, 271, 273, 275, 277, 279, 281, 287, 289, 297, 305, 307, 309-311, 313-331, 346, 373-377, 380, or 381 from that publication, which sequences are incorporated herein by reference).

In one aspect, exemplary multi-specific fusion proteins containing a CD86 binding domain as described herein will also contain at least one additional binding region or domain that is specific for a target other than a CD86 (a "heterologous binding domain"). For example, a multi-specific fusion protein of this disclosure has a CD86 binding domain linked by an intervening domain to a binding domain that is an IL-10 agonist, an HLA-G agonist, an HGF agonist, an IL-35 agonist, a PD-1 agonist, a BTLA agonist, a LIGHT antagonist, a GITRL antagonist or a CD40 antagonist. In certain embodiments, a multi-specific fusion protein comprises a first and second binding domain, a first and second linker, and an intervening domain, wherein one end of the intervening domain is fused via the first linker to a first binding domain that is a CD86 binding domain (e.g., a CTLA4 ectodomain, a CD28 ectodomain, an anti-CD86) and at the other end is fused via the second linker to a different binding domain that is an IL-10 agonist, an HLA-G agonist, an HGF agonist, an IL-35 agonist, a PD-1 agonist, a BTLA agonist, a LIGHT antagonist, a GITRL antagonist or a CD40 antagonist.

In certain embodiments, the first linker and second linker of a multi-specific fusion protein of this disclosure are each independently selected from, for example, Linkers 1-133 as provided in SEQ ID NOS:43-166 and the linkers provided in SEQ ID NOS:244, 307, 320, 355-379 and 383-398. For example, the first or second linker can be any one of Linkers 47, 58, 126-131 (SEQ ID NOS:89, 100, and 159-164, respectively), or the linkers provided in SEQ ID NO:244 or 355-379, or any combination thereof. In further examples, one linker is Linker 47 (SEQ ID NO:89) or Linker 132 (SEQ ID NO:165) and the other linker is the linker provided in SEQ ID NO:355, or Linker 127 (SEQ ID NO:160) or one linker is Linker 58 (SEQ ID NO:100) or Linker 133 (SEQ ID NO:166) and the other linker is Linker 126 (SEQ ID NO:159), or one linker is Linker 58 (SEQ ID NO:100) or Linker 133 (SEQ ID NO:166) and the other linker is Linker 127 (SEQ ID NO:160), or one linker is Linker 58 (SEQ ID NO:100) or Linker 133 (SEQ ID NO:166) and the other linker is Linker 128 (SEQ ID NO:161), or one linker is Linker 58 (SEQ ID NO:100) or Linker 133 (SEQ ID NO:166) and the other linker is Linker 129 (SEQ ID NO:162). In further examples, binding domains of this disclosure that comprise $V_H$ and $V_L$ domains, such as those specific for CD86, can have a further (third) linker between the $V_H$ and $V_L$ domains, such as the linker provided in SEQ ID NO:244, SEQ ID NO:89, Linker 46 (SEQ ID NO:88), Linker 130 (SEQ ID NO:163), or Linker 131 (SEQ ID NO:164). In any of these embodiments, the linkers may be flanked by one to five additional amino acids internally (e.g., Linker 131 has an alanine internal to the ($G_4S$) core sequence), on either end (e.g., Linker 130 has a serine on the amino-end of the ($G_4S$) core sequence) or on both ends (e.g., Linker 120 has two amino acids (asparagine-tyrosine) on one end and three amino acids (glycine-asparagine-serine) one the other end of the ($G_4S$) core sequence), which may simply be a result of creating such a recombinant molecule (e.g., use of a particular restriction enzyme site to join nucleic acid molecules may result in the insertion of one to several amino acids), and for purposes of this disclosure may be considered a part of any particular linker core sequence.

In further embodiments, the intervening domain of a multi-specific fusion protein of this disclosure is comprised of an immunoglobulin constant region or sub-region, wherein the intervening domain is disposed between a CD86 binding domain and a binding domain that is an IL-10 agonist, an HLA-G agonist, an HGF agonist, an IL-35 agonist, a PD-1 agonist, a BTLA agonist, a LIGHT antagonist, a GITRL antagonist or a CD40 antagonist. In certain embodiments, the intervening domain of a multi-specific fusion protein of this disclosure has a CD86 binding domain at the amino-terminus and a binding domain that is an IL-10 agonist, an HLA-G agonist, an HGF agonist, an IL-35 agonist, a PD-1 agonist, a BTLA agonist, a LIGHT antagonist, a GITRL antagonist or a CD40 antagonist at the carboxy-terminus. In other embodiments, the intervening domain of a multi-specific fusion protein of this disclosure has a binding domain that is an IL-10 agonist, an HLA-G agonist, an HGF agonist, an IL-35 agonist, a PD-1 agonist, a BTLA agonist, a LIGHT antagonist, a GITRL antagonist or a CD40 antagonist at the amino-terminus and a CD86 binding domain at the carboxy-terminus.

In further embodiments, the immunoglobulin constant region sub-region includes CH2 and CH3 domains of immunoglobulin G1 (IgG1). In related embodiments, the IgG1 CH2 and CH3 domains have one or more of the following amino acids mutated (i.e., have a different amino acid at that position): leucine at position 234 (L234), leucine at position 235 (L235), glycine at position 237 (G237), glutamate at position 318 (E318), lysine at position 320 (K320), lysine at position 322 (K322), or any combination thereof (numbering according to Kabat). For example, any one of these amino acids can be changed to alanine. In a further embodiment, according to Kabat numbering, the CH2 domain has each of L234, L235, and G237 mutated to an alanine (i.e., L234A, L235A, and G237A, respectively), and the IgG1 CH3 domain has each of E318, K320, and K322 mutated to an alanine (i.e., E318A, K320A, and K322A, respectively).

In certain embodiments, a multi-specific fusion protein of this disclosure may comprise a small modular immunopharmaceutical" (SMIP™). In this regard, the term SMIP™ refers to a highly modular compound class having enhanced drug properties over monoclonal and recombinant antibodies. SMIPs comprise a single polypeptide chain including a target-specific binding domain, based, for example, upon an antibody variable domain, in combination with a variable FC region that permits the specific recruitment of a desired class of effector cells (such as, e.g., macrophages and natural killer (NK) cells) and/or recruitment of complement-mediated killing. Depending upon the choice of target and hinge regions, SMIPs can signal or block signaling via cell surface receptors. As used herein, engineered fusion proteins, termed "small modular immunopharmaceutical" or "SMIP™ products", are as described in US Patent Publication Nos. 2003/133939, 2003/0118592, and 2005/0136049, and International Patent Publications WO02/056910, WO2005/037989, and WO2005/017148.

In some embodiments, a multi-specific fusion protein may comprise a PIMS molecule such as those described in US Patent Publication No. 2009/0148447 and International Patent Publication WO2009/023386.

In certain embodiments, the multi-specific fusion proteins of the invention can be engineered with different front and back end affinities in order to target specific cell types. For example, use of an anti-CD86 binding domain (e.g., 3D1, FUN1, or humanized variants thereof) that has a higher affinity for CD86 than an engineered IL10 agonist (e.g., having an I87A or I87S mutation, or a monoIL10 structure) has for huIL10R1, and combining such molecules in an xceptor molecule of this disclosure can be used to favor targeting to a specific cell type of interest, such as antigen-presenting cells (APCs). In this regard, fusion proteins can be made that have higher or lower affinity for CD86 or higher or lower affinity for any of the heterologous target proteins described herein, depending on the desired cell type to target. In preferred embodiments, the CD86 antagonist binding domain preferentially targets the multi-target specific xceptor molecule to APCs by having a greater affinity for CD86 than the heterologous binding domain has for its binding partner.

In some embodiments, a multi-specific fusion protein of this disclosure has a CD86 binding domain that comprises a CTLA4 extracellular domain or sub-domain, a CD28 extracellular domain or sub-domain, or a CD86-specific antibody-derived binding domain. In certain embodiments, a CD86-specific antibody-derived binding domain is derived from the FUN1 monoclonal antibody (see e.g., J. Pathol. 1993 March; 169(3):309-15); or derived from the 3D1 anti-CD86 monoclonal antibody. In certain embodiments, a CD86 binding domain is a sCTLA4, such as the mature polypeptide sequence of SEQ ID NO:1. In certain embodiments, the CD86 binding domain is a sCTLA4, such as the sequence of SEQ ID NO:1 or a variable-like domain of CTLA4, such as SEQ ID NO:3, or a sub-domain thereof. In other embodiments, a CD86 binding domain is a sCD28, such as the mature polypeptide sequence of SEQ ID NO:2 (signal peptide: amino acids 1-18). In still further embodiments, the CD86 binding domain comprises light and heavy chain variable domains from FUN1 (e.g., SEQ ID NOS:305 and 306) or 3D1 (e.g., SEQ ID NOS:318 and 319), preferably in the form of an scFv.

In further embodiments, a multi-specific fusion protein of this disclosure has a CD86 binding domain and a heterologous binding domain that is an IL-10 agonist, an HLA-G agonist, an HGF agonist, an IL-35 agonist, a PD-1 agonist, a BTLA agonist, a LIGHT antagonist, a GITRL antagonist or a CD40 antagonist (see e.g., the amino acid sequences of heterologous binding domains provided in SEQ ID NOS:7, 14, 15, 18-22, 25, 26, 29, 32, 33, 36, 39 and 40).

Exemplary structures of such multi-specific fusion proteins, referred to herein as Xceptor molecules, include N-BD1-ID-BD2-C, N-BD2-ID-BD1-C, wherein N and C represent the amino-terminus and carboxy-terminus, respectively; BD1 is a CD86 binding domain, such as an immunoglobulin-like or immunoglobulin variable region binding domain, or an ectodomain; X is an intervening domain, and BD2 is binding domain that is an IL-10 agonist, an HLA-G agonist, an HGF agonist, an IL-35 agonist, a PD-1 agonist, a BTLA agonist, a LIGHT antagonist, a GITRL antagonist or a CD40 antagonist. In some constructs, X can comprise an immunoglobulin constant region or sub-region disposed between the first and second binding domains. In some embodiments, a multi-specific fusion protein of this disclosure has an intervening domain (X) comprising, from amino-terminus to carboxy-terminus, a structure as follows: -L1-X-L2-, wherein L1 and L2 are each independently a linker comprising from two to about 150 amino acids; and X is an immunoglobulin constant region or sub-region. In further embodiments, the multi-specific fusion protein will have an intervening domain that is albumin, transferrin, or another serum protein binding protein, wherein the fusion protein remains primarily or substantially as a single chain polypeptide in a composition.

The amino acid sequences of exemplary Xceptor fusion proteins are provided in SEQ ID NOS:9, 13, 17, 24, 28, 31, 35, 38, 42, 171, 173, 175, 177, 179, 181, 183, 185, 187, 189, 191, 193, 195, 197, 199, 201, 203, 205, 207, 209, 211, 213, 215, 217, 219, 221, 223, 237, 239, 252, 254, 256, 258, 260, 262, 266, 276, 302, 330, 334, 336, 338, 340, 350, 352, and 354; encoded by the polynucleotide sequences provided in SEQ ID NOS:8, 12, 16, 23, 27, 30, 34, 37, 41, 170, 172, 174, 176, 178, 180, 182, 184, 186, 188, 190, 192, 194, 196, 198, 200, 202, 204, 206, 208, 210, 212, 214, 216, 218, 220, 222, 236, 238, 251, 253, 255, 257, 259, 261, 265, 275, 301, 329, 333, 335, 337, 339, 349, 351 and 353 respectively.

In still further embodiments, a multi-specific fusion protein of this disclosure has the following structure: N-BD1-X-L2-BD2-C, wherein BD1 is a CD86 binding domain, such a binding domain that is at least about 90% identical to a CTLA4 ectodomain; —X— is -L1-CH2CH3-, wherein L1 is a first IgG1 hinge, optionally mutated by substituting the first or second cysteine and wherein —CH2CH3- is the CH2CH3 region of an IgG1 Fc domain; L2 is a linker selected from SEQ ID NOS:43-166, 244, 307, 320, 355-379 and 383-398; and BD2 is a binding domain that is an IL-10 agonist, an HLA-G agonist, an HGF agonist, an IL-35 agonist, a PD-1 agonist, a BTLA agonist, a LIGHT antagonist, a GITRL antagonist or a CD40 antagonist, as described herein.

In particular embodiments, a multi-specific Xceptor fusion protein has (a) a CD86 binding domain comprising an amino acid sequence at least 80%, 90%, 95%, 96%, 97%, 98%, 99% or at least 100% identical to a mature polypeptide sequence of SEQ ID NO:1 or SEQ ID NO: 2, and (b) a binding domain that is an IL-10 agonist, an HLA-G agonist, an HGF agonist, an IL-35 agonist, a PD-1 agonist, a BTLA agonist, a LIGHT antagonist, a GITRL antagonist or a CD40 antagonist comprising an amino acid sequence at least 80%, 90%, 95%, 96%, 97%, 98%, 99% or at least 100% identical to a corresponding mature polypeptide sequence of the aforementioned heterologous binding proteins as provided in SEQ ID NOS:7, 14, 15, 18-22, 25, 26, 29, 32, 33, 36, 39 and 40), wherein, from amino-terminus to carboxy-terminus or from carboxy-terminus to amino-terminus, (i) a CD86 binding domain of (a) or binding domain of (b) is fused to a first linker, (ii) the first linker is fused to an immunoglobulin heavy chain constant region of CH2 and CH3 as set forth in any one of SEQ ID NOS:409 and 415-417, (iii) the CH2CH3 constant region polypeptide is fused to a second linker, and (iv) the second linker is fused to a CD86 binding domain of (a) or a binding domain of (b). In certain embodiments, the first linker is Linker 47 (SEQ ID NO:89), Linker 132 (SEQ ID NO:165) or Linker 133 (SEQ ID NO:166), the second linker is any one of Linkers 126-129 (SEQ ID NOS:159-162), and a further (third) linker between the CD86 binding domain $V_H$ and $V_L$ domains is Linker 130 (SEQ ID NO:163) or Linker 131 (SEQ ID NO:164).

The amino acid sequences of exemplary Xceptor fusion proteins are provided in SEQ ID NOS:9, 13, 17, 24, 28, 31, 35, 38, 42, 171, 173, 175, 177, 179, 181, 183, 185, 187, 189, 191, 193, 195, 197, 199, 201, 203, 205, 207, 209, 211, 213, 215, 217, 219, 221, 223, 237, 239, 252, 254, 256, 258, 260, 262, 266, 276, 302, 330, 334, 336, 338, 340, 350, 352, and 354; encoded by the polynucleotide sequences provided in SEQ ID Nos:8, 12, 16, 23, 27, 30, 34, 37, 41, 170, 172, 174, 176, 178, 180, 182, 184, 186, 188, 190, 192, 194, 196, 198, 200, 202, 204, 206, 208, 210, 212, 214, 216, 218, 220, 222, 236, 238, 251, 253, 255, 257, 259, 261, 265, 275, 301, 329, 333, 335, 337, 339, 349, 351 and 353 respectively.

Making Multi-Specific Fusion Proteins

To efficiently produce any of the binding domain polypeptides or fusion proteins described herein, a leader peptide is used to facilitate secretion of expressed polypeptides and fusion proteins. Using any of the conventional leader peptides (signal sequences) is expected to direct nascently expressed polypeptides or fusion proteins into a secretory pathway and to result in cleavage of the leader peptide from the mature polypeptide or fusion protein at or near the junction between the leader peptide and the polypeptide or fusion protein. A particular leader peptide will be chosen based on considerations known in the art, such as using sequences encoded by polynucleotides that allow the easy inclusion of restriction endonuclease cleavage sites at the beginning or end of the coding sequence for the leader peptide to facilitate molecular engineering, provided that such introduced sequences specify amino acids that either do not interfere unacceptably with any desired processing of the leader peptide from the nascently expressed protein or do not interfere unacceptably with any desired function of a polypeptide or fusion protein molecule if the leader peptide is not cleaved during maturation of the polypeptides or fusion proteins. Exemplary leader peptides of this disclosure include natural leader sequences (i.e., those expressed with the native protein) or use of heterologous leader sequences, such as $H_3N$-MDFQVQIFSFLLISASVIMSRG(X)$_n$—$CO_2H$, wherein X is any amino acid and n is zero to three (SEQ ID NOS:167, 419, 420, and 421) or $H_3N$-MEAPAQLLFLLLLWLPDTTG-$CO_2H$ (SEQ ID NO:168).

As noted herein, variants and derivatives of binding domains, such as ectodomains, light and heavy variable regions, and CDRs described herein, are contemplated. In one example, insertion variants are provided wherein one or more amino acid residues supplement a specific binding agent amino acid sequence. Insertions may be located at either or both termini of the protein, or may be positioned within internal regions of the specific binding agent amino acid sequence. Variant products of this disclosure also include mature specific binding agent products, i.e., specific binding agent products wherein a leader or signal sequence is removed, and the resulting protein having additional amino terminal residues. The additional amino terminal residues may be derived from another protein, or may include one or more residues that are not identifiable as being derived from a specific protein. Polypeptides with an additional methionine residue at position −1 are contemplated, as are polypeptides of this disclosure with additional methionine and lysine residues at positions −2 and −1. Variants having additional Met, Met-Lys, or Lys residues (or one or more basic residues in general) are particularly useful for enhanced recombinant protein production in bacterial host cells.

As used herein, "amino acids" refer to a natural (those occurring in nature) amino acid, a substituted natural amino acid, a non-natural amino acid, a substituted non-natural amino acid, or any combination thereof. The designations for natural amino acids are herein set forth as either the standard one- or three-letter code. Natural polar amino acids include asparagine (Asp or N) and glutamine (Gln or Q); as well as basic amino acids such as arginine (Arg or R), lysine (Lys or K), histidine (H is or H), and derivatives thereof; and acidic amino acids such as aspartic acid (Asp or D) and glutamic acid (Glu or E), and derivatives thereof. Natural hydrophobic amino acids include tryptophan (Trp or W), phenylalanine (Phe or F), isoleucine (Ile or I), leucine (Leu or L), methionine (Met or M), valine (Val or V), and derivatives thereof; as well as other non-polar amino acids such as glycine (Gly or G), alanine (Ala or A), proline (Pro or P), and derivatives thereof. Natural amino acids of intermediate polarity include serine (Ser or S), threonine (Thr or T), tyrosine (Tyr or Y), cysteine (Cys or C), and derivatives thereof. Unless specified otherwise, any amino acid described herein may be in either the D- or L-configuration.

Substitution variants include those fusion proteins wherein one or more amino acid residues in an amino acid sequence are removed and replaced with alternative residues. In some embodiments, the substitutions are conservative in nature; however, this disclosure embraces substitutions that are also non-conservative. Amino acids can be classified according to physical properties and contribution to secondary and tertiary protein structure. A conservative substitution is recognized in the art as a substitution of one amino acid for another amino acid that has similar properties. Exemplary conservative substitutions are set out in Table 1 (see WO 97/09433, page 10, published Mar. 13, 1997), immediately below.

TABLE 1

Conservative Substitutions I

| Side Chain | Characteristic | Amino Acid |
|---|---|---|
| Aliphatic | Non-polar | G, A, P, I, L, V |
| | Polar-uncharged | S, T, M, N, Q |
| | Polar-charged | D, E, K, R |
| Aromatic | | H, F, W, Y |
| Other | | N, Q, D, E |

Alternatively, conservative amino acids can be grouped as described in Lehninger (Biochemistry, Second Edition; Worth Publishers, Inc. NY:NY (1975), pp. 71-77) as set out in Table 2, immediately below.

TABLE 2

Conservative Substitutions II

| Side Chain | Characteristic | Amino Acid |
|---|---|---|
| Non-polar (hydrophobic) | Aliphatic: | A, L, I, V, P |
| | Aromatic | F, W |
| | Sulfur-containing | M |
| | Borderline | G |
| Uncharged-polar | Hydroxyl | S, T, Y |
| | Amides | N, Q |
| | Sulfhydryl | C |
| | Borderline | G |
| Positively Charged (Basic) | | K, R, H |
| Negatively Charged (Acidic) | | D, E |

Variants or derivatives can also have additional amino acid residues which arise from use of specific expression systems. For example, use of commercially available vectors that express a desired polypeptide as part of a glutathione-S-transferase (GST) fusion product provides the desired polypeptide having an additional glycine residue at position −1 after cleavage of the GST component from the desired polypeptide. Variants which result from expression in other vector systems are also contemplated, including those wherein histidine tags are incorporated into the amino acid sequence, generally at the carboxy and/or amino terminus of the sequence.

Deletion variants are also contemplated wherein one or more amino acid residues in a binding domain of this disclosure are removed. Deletions can be effected at one or both termini of the fusion protein, or from removal of one or more residues within the amino acid sequence.

In certain illustrative embodiments, fusion proteins of this disclosure are glycosylated, the pattern of glycosylation being dependent upon a variety of factors including the host cell in which the protein is expressed (if prepared in recombinant host cells) and the culture conditions.

This disclosure also provides derivatives of fusion proteins. Derivatives include specific binding domain polypeptides bearing modifications other than insertion, deletion, or substitution of amino acid residues. In certain embodiments, the modifications are covalent in nature, and include for example, chemical bonding with polymers, lipids, other organic, and inorganic moieties. Derivatives of this disclosure may be prepared to increase circulating half-life of a specific binding domain polypeptide, or may be designed to improve targeting capacity for the polypeptide to desired cells, tissues, or organs.

This disclosure further embraces fusion proteins that are covalently modified or derivatized to include one or more water-soluble polymer attachments such as polyethylene glycol, polyoxyethylene glycol, or polypropylene glycol, as described U.S. Pat. Nos. 4,640,835; 4,496,689; 4,301,144; 4,670,417; 4,791,192 and 4,179,337. Still other useful polymers known in the art include monomethoxy-polyethylene glycol, dextran, cellulose, and other carbohydrate-based polymers, poly-(N-vinyl pyrrolidone)-polyethylene glycol, propylene glycol homopolymers, a polypropylene oxide/ethylene oxide co-polymer, polyoxyethylated polyols (e.g., glycerol) and polyvinyl alcohol, as well as mixtures of these polymers. Particularly preferred are polyethylene glycol (PEG)-derivatized proteins. Water-soluble polymers may be bonded at specific positions, for example at the amino terminus of the proteins and polypeptides according to this disclosure, or randomly attached to one or more side chains of the polypeptide. The use of PEG for improving therapeutic capacities is described in U.S. Pat. No. 6,133,426.

A particular embodiment of this disclosure is an immunoglobulin or an Fc fusion protein. Such a fusion protein can have a long half-life, e.g., several hours, a day or more, or even a week or more, especially if the Fc domain is capable of interacting with FcRn, the neonatal Fc receptor. The binding site for FcRn in an Fc domain is also the site at which the bacterial proteins A and G bind. The tight binding between these proteins can be used as a means to purify antibodies or fusion proteins of this disclosure by, for example, employing protein A or protein G affinity chromatography during protein purification.

Protein purification techniques are well known to those of skill in the art. These techniques involve, at one level, the crude fractionation of the polypeptide and non-polypeptide fractions. Further purification using chromatographic and electrophoretic techniques to achieve partial or complete purification (or purification to homogeneity) is frequently desired. Analytical methods particularly suited to the preparation of a pure fusion protein are ion-exchange chromatography; exclusion chromatography; polyacrylamide gel electrophoresis; and isoelectric focusing. Particularly efficient methods of purifying peptides are fast protein liquid chromatography and HPLC.

Certain aspects of the present disclosure concern the purification, and in particular embodiments, the substantial purification, of a fusion protein. The term "purified fusion protein" as used herein, is intended to refer to a composition, isolatable from other components, wherein the fusion protein is purified to any degree relative to its naturally obtainable state. A purified fusion protein therefore also refers to a fusion protein, free from the environment in which it may naturally occur.

Generally, "purified" will refer to a fusion protein composition that has been subjected to fractionation to remove various other components, and which composition substantially retains its expressed biological activity. Where the term "substantially purified" is used, this designation refers to a fusion binding protein composition in which the fusion protein forms the major component of the composition, such as constituting about 50%, about 60%, about 70%, about 80%, about 90%, about 95%, about 99% or more of the protein, by weight, in the composition.

Various methods for quantifying the degree of purification are known to those of skill in the art in light of the present disclosure. These include, for example, determining the specific binding activity of an active fraction, or assessing the amount of fusion protein in a fraction by SDS/PAGE analysis. A preferred method for assessing the purity of a protein fraction is to calculate the binding activity of the fraction, to compare it to the binding activity of the initial extract, and to thus calculate the degree of purification, herein assessed by a "-fold purification number." The actual units used to represent the amount of binding activity will, of course, be dependent upon the particular assay technique chosen to follow the purification and whether or not the expressed fusion protein exhibits a detectable binding activity.

Various techniques suitable for use in protein purification are well known to those of skill in the art. These include, for example, precipitation with ammonium sulfate, PEG, antibodies and the like, or by heat denaturation, followed by centrifugation; chromatography steps such as ion exchange, gel filtration, reverse phase, hydroxylapatite, and affinity chromatography; isoelectric focusing; gel electrophoresis; and combinations of these and other techniques. As is generally known in the art, it is believed that the order of conducting the various purification steps may be changed, or that certain steps may be omitted, and still result in a suitable method for the preparation of a substantially purified protein.

There is no general requirement that the fusion protein always be provided in its most purified state. Indeed, it is contemplated that less substantially purified proteins will have utility in certain embodiments. Partial purification may be accomplished by using fewer purification steps in combination, or by utilizing different forms of the same general purification scheme. For example, it is appreciated that a cation-exchange column chromatography performed utilizing an HPLC apparatus will generally result in greater purification than the same technique utilizing a low pressure chromatography system. Methods exhibiting a lower degree of relative purification may have advantages in total recovery of protein product, or in maintaining binding activity of an expressed protein.

It is known that the migration of a polypeptide can vary, sometimes significantly, with different conditions of SDS/PAGE (Capaldi et al. (1977) Biochem. Biophys. Res. Comm. 76:425). It will therefore be appreciated that under differing electrophoresis conditions, the apparent molecular weights of purified or partially purified fusion protein expression products may vary.

Polynucleotides, Expression Vectors, and Host Cells

This disclosure provides polynucleotides (isolated or purified or pure polynucleotides) encoding the multi-specific fusion protein of this disclosure, vectors (including cloning vectors and expression vectors) comprising such polynucleotides, and cells (e.g., host cells) transformed or transfected with a polynucleotide or vector according to this disclosure.

In certain embodiments, a polynucleotide (DNA or RNA) encoding a binding domain of this disclosure, or a multi-specific fusion protein containing one or more such binding domains is contemplated. Expression cassettes encoding multi-specific fusion protein constructs are provided in the examples appended hereto.

The present disclosure also relates to vectors that include a polynucleotide of this disclosure and, in particular, to recombinant expression constructs. In one embodiment, this disclosure contemplates a vector comprising a polynucleotide encoding a multi-specific fusion protein containing a CD86 binding domain and an IL-10 agonist, an HLA-G agonist, an HGF agonist, an IL-35 agonist, a PD-1 agonist, a BTLA agonist, a LIGHT antagonist, a GITRL antagonist or a CD40 antagonist domain of this disclosure, along with other polynucleotide sequences that cause or facilitate transcription, translation, and processing of such multi-specific fusion protein-encoding sequences.

Appropriate cloning and expression vectors for use with prokaryotic and eukaryotic hosts are described, for example, in Sambrook et al., Molecular Cloning: A Laboratory Manual, Second Edition, Cold Spring Harbor, N.Y., (1989). Exemplary cloning/expression vectors include cloning vectors, shuttle vectors, and expression constructs, that may be based on plasmids, phagemids, phasmids, cosmids, viruses, artificial chromosomes, or any nucleic acid vehicle known in the art suitable for amplification, transfer, and/or expression of a polynucleotide contained therein As used herein, "vector" means a nucleic acid molecule capable of transporting another nucleic acid to which it has been linked. Exemplary vectors include plasmids, yeast artificial chromosomes, and viral genomes. Certain vectors can autonomously replicate in a host cell, while other vectors can be integrated into the genome of a host cell and thereby are replicated with the host genome. In addition, certain vectors are referred to herein as "recombinant expression vectors" (or simply, "expression vectors"), which contain nucleic acid sequences that are operatively linked to an expression control sequence and, therefore, are capable of directing the expression of those sequences.

In certain embodiments, expression constructs are derived from plasmid vectors. Illustrative constructs include modified pNASS vector (Clontech, Palo Alto, Calif.), which has nucleic acid sequences encoding an ampicillin resistance gene, a polyadenylation signal and a T7 promoter site; pDEF38 and pNEF38 (CMC ICOS Biologics, Inc.), which have a CHEF1 promoter; and pD18 (Lonza), which has a CMV promoter. Other suitable mammalian expression vectors are well known (see, e.g., Ausubel et al., 1995; Sambrook et al., supra; see also, e.g., catalogs from Invitrogen, San Diego, Calif.; Novagen, Madison, Wis.; Pharmacia, Piscataway, N.J.). Useful constructs may be prepared that include a dihydrofolate reductase (DHFR)-encoding sequence under suitable regulatory control, for promoting enhanced production levels of the fusion proteins, which levels result from gene amplification following application of an appropriate selection agent (e.g., methotrexate).

Generally, recombinant expression vectors will include origins of replication and selectable markers permitting transformation of the host cell, and a promoter derived from a highly-expressed gene to direct transcription of a downstream structural sequence, as described above. A vector in operable linkage with a polynucleotide according to this disclosure yields a cloning or expression construct. Exemplary cloning/expression constructs contain at least one expression control element, e.g., a promoter, operably linked to a polynucleotide of this disclosure. Additional expression control elements, such as enhancers, factor-specific binding sites, terminators, and ribosome binding sites are also contemplated in the vectors and cloning/expression constructs according to this disclosure. The heterologous structural sequence of the polynucleotide according to this disclosure is assembled in appropriate phase with translation initiation and termination sequences. Thus, for example, the fusion protein-encoding nucleic acids as provided herein may be included in any one of a variety of expression vector constructs as a recombinant expression construct for expressing such a protein in a host cell.

The appropriate DNA sequence(s) may be inserted into a vector, for example, by a variety of procedures. In general, a DNA sequence is inserted into an appropriate restriction endonuclease cleavage site(s) by procedures known in the art. Standard techniques for cloning, DNA isolation, amplification and purification, for enzymatic reactions involving DNA ligase, DNA polymerase, restriction endonucleases and the like, and various separation techniques are contemplated. A number of standard techniques are described, for example, in Ausubel et al. (*Current Protocols in Molecular Biology*, Greene Publ. Assoc. Inc. & John Wiley & Sons, Inc., Boston, Mass., 1993); Sambrook et al. (*Molecular Cloning*, Second Ed., Cold Spring Harbor Laboratory, Plainview, N.Y., 1989); Maniatis et al. (*Molecular Cloning*, Cold Spring Harbor Laboratory, Plainview, N.Y., 1982); Glover (Ed.) (*DNA Cloning* Vol. I and II, IRL Press, Oxford, UK, 1985); Hames and Higgins (Eds.) (*Nucleic Acid Hybridization*, IRL Press, Oxford, UK, 1985); and elsewhere.

The DNA sequence in the expression vector is operatively linked to at least one appropriate expression control sequence (e.g., a constitutive promoter or a regulated promoter) to direct mRNA synthesis. Representative examples of such expression control sequences include promoters of eukaryotic cells or their viruses, as described above. Promoter regions can be selected from any desired gene using CAT (chloramphenicol transferase) vectors or other vectors with selectable markers. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art, and preparation of certain particularly preferred recombinant expression constructs comprising at least one promoter or regulated promoter operably linked to a nucleic acid encoding a protein or polypeptide according to this disclosure is described herein.

Variants of the polynucleotides of this disclosure are also contemplated. Variant polynucleotides are at least 90%, and preferably 95%, 99%, or 99.9% identical to one of the polynucleotides of defined sequence as described herein, or that hybridizes to one of those polynucleotides of defined sequence under stringent hybridization conditions of 0.015M sodium chloride, 0.0015M sodium citrate at about 65-68° C. or 0.015M sodium chloride, 0.0015M sodium citrate, and 50% formamide at about 42° C. The polynucleotide variants retain the capacity to encode a binding domain or fusion protein thereof having the functionality described herein.

The term "stringent" is used to refer to conditions that are commonly understood in the art as stringent. Hybridization stringency is principally determined by temperature, ionic strength, and the concentration of denaturing agents such as formamide. Examples of stringent conditions for hybridization and washing are 0.015M sodium chloride, 0.0015M sodium citrate at about 65-68° C. or 0.015M sodium chloride, 0.0015M sodium citrate, and 50% formamide at about 42° C. (see Sambrook et al., *Molecular Cloning: A Laboratory Manual*, 2nd Ed., Cold Spring Harbor Laboratory, Cold Spring Harbor, N.Y., 1989).

More stringent conditions (such as higher temperature, lower ionic strength, higher formamide, or other denaturing agent) may also be used; however, the rate of hybridization will be affected. In instances wherein hybridization of deoxyoligonucleotides is concerned, additional exemplary stringent hybridization conditions include washing in 6×SSC, 0.05% sodium pyrophosphate at 37° C. (for 14-base oligonucleotides), 48° C. (for 17-base oligonucleotides), 55° C. (for 20-base oligonucleotides), and 60° C. (for 23-base oligonucleotides).

A further aspect of this disclosure provides a host cell transformed or transfected with, or otherwise containing, any of the polynucleotides or vector/expression constructs of this disclosure. The polynucleotides or cloning/expression constructs of this disclosure are introduced into suitable cells using any method known in the art, including transformation, transfection and transduction. Host cells include the cells of a subject undergoing ex vivo cell therapy including, for example, ex vivo gene therapy. Eukaryotic host cells contemplated as an aspect of this disclosure when harboring a polynucleotide, vector, or protein according to this disclosure include, in addition to a subject's own cells (e.g., a human patient's own cells), VERO cells, HeLa cells, Chinese hamster ovary (CHO) cell lines (including modified CHO cells capable of modifying the glycosylation pattern of expressed multivalent binding molecules, see US Patent Application Publication No. 2003/0115614), COS cells (such as COS-7), W138, BHK, HepG2, 3T3, RIN, MDCK, A549, PC12, K562, HEK293 cells, HepG2 cells, N cells, 3T3 cells, *Spodoptera frugiperda* cells (e.g., Sf9 cells), *Saccharomyces cerevisiae* cells, and any other eukaryotic cell known in the art to be useful in expressing, and optionally isolating, a protein or peptide according to this disclosure. Also contemplated are prokaryotic cells, including *Escherichia coli, Bacillus subtilis, Salmonella typhimurium*, a Streptomycete, or any prokaryotic cell known in the art to be suitable for expressing, and optionally isolating, a protein or peptide according to this disclosure. In isolating protein or peptide from prokaryotic cells, in particular, it is contemplated that techniques known in the art for extracting protein from inclusion bodies may be used. The selection of an appropriate host is within the scope of those skilled in the art from the teachings herein. Host cells that glycosylate the fusion proteins of this disclosure are contemplated.

The term "recombinant host cell" (or simply "host cell") refers to a cell containing a recombinant expression vector. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein.

Recombinant host cells can be cultured in a conventional nutrient medium modified as appropriate for activating promoters, selecting transformants, or amplifying particular genes. The culture conditions for particular host cells selected for expression, such as temperature, pH and the like, will be readily apparent to the ordinarily skilled artisan. Various mammalian cell culture systems can also be employed to express recombinant protein. Examples of mammalian expression systems include the COS-7 lines of monkey kidney fibroblasts, described by Gluzman (1981) Cell 23:175, and other cell lines capable of expressing a compatible vector, for example, the C127, 3T3, CHO, HeLa and BHK cell lines. Mammalian expression vectors will comprise an origin of replication, a suitable promoter and, optionally, enhancer, and also any necessary ribosome binding sites, polyadenylation site, splice donor and acceptor sites, transcriptional termination sequences, and 5'-flanking nontranscribed sequences, for example, as described herein regarding the preparation of multivalent binding protein expression constructs. DNA sequences derived from the SV40 splice, and polyadenylation sites may be used to provide the required nontranscribed genetic elements. Introduction of the construct into the host cell can be effected by a variety of methods with which those skilled in the art will be familiar, including calcium phosphate transfection, DEAE-Dextran-mediated transfection, or electroporation (Davis et al. (1986) Basic Methods in Molecular Biology).

In one embodiment, a host cell is transduced by a recombinant viral construct directing the expression of a protein or polypeptide according to this disclosure. The transduced host cell produces viral particles containing expressed protein or polypeptide derived from portions of a host cell membrane incorporated by the viral particles during viral budding.

Compositions and Methods of Use

To treat human or non-human mammals suffering a disease state associated with CD86, IL-10, HLA-G, IL-35, PD-1, BTLA, LIGHT, GITRL or CD40 dysregulation, a multi-specific fusion protein of this disclosure is administered to the subject in an amount that is effective to ameliorate symptoms of the disease state following a course of one or more administrations. Being polypeptides, the multi-specific fusion proteins of this disclosure can be suspended or dissolved in a pharmaceutically acceptable diluent, optionally including a stabilizer of other pharmaceutically acceptable excipients, which can be used for intravenous administration by injection or infusion, as more fully discussed below.

A pharmaceutically effective dose is that dose required to prevent, inhibit the occurrence of, or treat (alleviate a symptom to some extent, preferably all symptoms of) a disease state. The pharmaceutically effective dose depends on the type of disease, the composition used, the route of administration, the type of subject being treated, the physical characteristics of the specific subject under consideration for treatment, concurrent medication, and other factors that those skilled in the medical arts will recognize. For example, an amount between 0.1 mg/kg and 100 mg/kg body weight (which can be administered as a single dose, or in multiple doses given hourly, daily, weekly, monthly, or any combination thereof that is an appropriate interval) of active ingredient may be administered depending on the potency of a binding domain polypeptide or multi-specific protein fusion of this disclosure.

In certain aspects, compositions of fusion proteins are provided by this disclosure. Pharmaceutical compositions of this disclosure generally comprise one or more type of binding domain or fusion protein in combination with a pharmaceutically acceptable carrier, excipient, or diluent. Such carriers will be nontoxic to recipients at the dosages and concentrations employed. Pharmaceutically acceptable carriers for therapeutic use are well known in the pharmaceutical art, and are described, for example, in Remington's Pharmaceutical Sciences, Mack Publishing Co. (A. R. Gennaro (Ed.) 1985). For example, sterile saline and phosphate buffered saline at physiological pH may be used. Preservatives, stabilizers, dyes and the like may be provided in the pharmaceutical composition. For example, sodium benzoate, sorbic acid, or esters of p-hydroxybenzoic acid may be added as preservatives. Id. at 1449. In addition, antioxidants and suspending agents may be used. Id. The compounds of the present invention may be used in either the free base or salt forms, with both forms being considered as being within the scope of the present invention.

Pharmaceutical compositions may also contain diluents such as buffers; antioxidants such as ascorbic acid, low molecular weight (less than about 10 residues) polypeptides, proteins, amino acids, carbohydrates (e.g., glucose, sucrose, or dextrins), chelating agents (e.g., EDTA), glutathione or other stabilizers or excipients. Neutral buffered saline or saline mixed with nonspecific serum albumin are exemplary appropriate diluents. Preferably, product is formulated as a lyophilizate using appropriate excipient solutions as diluents.

Compositions of this disclosure can be used to treat disease states in human and non-human mammals that are a result of or associated with CD86, IL-10, HLA-G, IL-35, PD-1, BTLA, LIGHT, GITRL or CD40 dysregulation. As discussed above, blocking of binding of CD86 to CD28, for example by administration of CTLA4Ig, has been shown to be effective in treating autoimmune disorders, such as rheumatoid arthritis. IL10 is known to have immunosuppressive properties (Commins et al. (2008) J. Allergy Clin. Immunol. 121:1108-11; Ming et al., (2008) Immunity 28:468-476), and beneficial responses have been seen following administration of IL10 to patients with psoriasis (Asadullah et al. (1999) Arch. Dermatol. 135:187-92) and inflammatory bowel disease (Schreiber et al. (2000) Gastroenterology 119:1461-72). As noted above, it has been suggested that HLA-G may be useful in reducing inflammatory responses in the CNS associated with multiple sclerosis (Wiendl et al. (2005) Blood, 128:2689-2704), and as a therapeutic agent in promoting tolerance to grafts in transplantations (Carosella et al. (2008) Blood 111:4862-4870). HGF has been shown to be effective in reducing disease both in a mouse model of arthritis and in a mouse model of asthma. IL35 has been shown to be effective in reducing disease in a mouse model of arthritis and to suppress T-cell proliferation. As discussed above, LIGHT antagonists have been shown to be effective in reducing graft vs. host disease and to suppress T-cell proliferation. In addition, LIGHT is believed to play a role in inflammatory bowel disease and Crohn's disease. PD1-L1 or PD1-L2 to PD-1 has been shown to be effective in reducing T-cell activation and cytokine production. BTLA has been shown to be effective in reducing T-cell activation and cytokine production. Binding of GITRL to GITR has been shown to increase disease severity in animal models of asthma and arthritis, and is known to increase T cell inflammatory and immune responses. As discussed above, CD40 signaling is involved in diseases such as autoimmune diseases, cancers, and organ and tissue graft rejections.

Thus, multi-specific fusion proteins of this disclosure are useful in treating various autoimmune and/or inflammatory disorders, such as rheumatoid arthritis, juvenile rheumatoid arthritis, asthma, systemic lupus erythematosus (SLE), inflammatory bowel disease (including Crohn's disease and ulcerative colitis), graft versus host disease, psoriasis, multiple sclerosis, dermatomyositis, polymyositis, pernicious anaemia, primary biliary cirrhosis, acute disseminated encephalomyelitis (ADEM), Addison's disease, ankylosing spondylitis, antiphospholipid antibody syndrome (APS) autoimmune hepatitis, diabetes mellitus type 1, Goodpasture's syndrome, Graves' disease, Guillain-Barré syndrome (GBS), Hashimoto's disease, idiopathic thrombocytopenic purpura, lupus erythematosus, pemphigus vulgaris, Sjögren's syndrome, temporal arteritis (also known as "giant cell arteritis"), autoimmune hemolytic anemia, bullous pemphigoid, vasculitis, coeliac disease, endometriosis, hidradenitis suppurativa, interstitial cystitis, morphea, scleroderma, narcolepsy, neuromyotonia, vitiligo and autoimmune inner ear disease. In addition, multi-specific fusion proteins of this disclosure are useful in suppressing detrimental immune alloresponse in organ transplant (including solid organ transplant or allograft), cell transplant, or the like.

"Pharmaceutically acceptable salt" refers to a salt of a binding domain polypeptide or fusion protein of this disclosure that is pharmaceutically acceptable and that possesses the desired pharmacological activity of the parent compound. Such salts include the following: (1) acid addition salts, formed with inorganic acids such as hydrochloric acid, hydrobromic acid, sulfuric acid, nitric acid, phosphoric acid, and the like; or formed with organic acids such as acetic acid, propionic acid, hexanoic acid, cyclopentanepropionic acid, glycolic acid, pyruvic acid, lactic acid, malonic acid, succinic acid, malic acid, maleic acid, fumaric acid, tartaric acid, citric acid, benzoic acid, 3-(4-hydroxybenzoyl)benzoic acid, cinnamic acid, mandelic acid, methanesulfonic acid, ethanesulfonic acid, 1,2-ethane-disulfonic acid, 2-hydroxyethanesulfonic acid, benzenesulfonic acid, 4-chlorobenzenesulfonic acid, 2-naphthalenesulfonic acid, 4-toluenesulfonic acid, camphorsulfonic acid, 4-methylbicyclo[2.2.2]-oct-2-ene-1-carboxylic acid, glucoheptonic acid, 3-phenylpropionic acid, trimethylacetic acid, tertiary butylacetic acid, lauryl sulfuric acid, gluconic acid, glutamic acid, hydroxynaphthoic acid, salicylic acid, stearic acid, muconic acid, and the like; or (2) salts formed when an acidic proton present in the parent compound either is replaced by a metal ion, e.g., an alkali metal ion, an alkaline earth ion, or an aluminum ion; or coordinates with an organic base such as ethanolamine, diethanolamine, triethanolamine, N-methylglucamine, or the like.

In particular illustrative embodiments, a polypeptide or fusion protein of this disclosure is administered intravenously by, for example, bolus injection or infusion. Routes of administration in addition to intravenous include oral, topical, parenteral (e.g., sublingually or buccally), sublingual, rectal, vaginal, and intranasal. The term parenteral as used herein includes subcutaneous injections, intravenous, intramuscular, intrasternal, intracavernous, intrathecal, intrameatal, intraurethral injection or infusion techniques. The pharmaceutical composition is formulated so as to allow the active ingredients contained therein to be bioavailable upon administration of the composition to a patient. Compositions that will be administered to a patient take the form of one or more dosage units, where for example, a tablet may be a single dosage unit, and a container of one or more compounds of this disclosure in aerosol form may hold a plurality of dosage units.

For oral administration, an excipient and/or binder may be present, such as sucrose, kaolin, glycerin, starch dextrans, cyclodextrins, sodium alginate, ethyl cellulose, and carboxy methylcellulose. Sweetening agents, preservatives, dye/colorant, flavor enhancer, or any combination thereof may optionally be present. A coating shell may also optionally be used.

In a composition intended to be administered by injection, one or more of a surfactant, preservative, wetting agent, dispersing agent, suspending agent, buffer, stabilizer, isotonic agent, or any combination thereof may optionally be included.

For nucleic acid-based formulations, or for formulations comprising expression products according to this disclosure, about 0.01 µg/kg to about 100 mg/kg body weight will be administered, for example, by the intradermal, subcutaneous, intramuscular, or intravenous route, or by any route known in the art to be suitable under a given set of circumstances. A preferred dosage, for example, is about 1 µg/kg to about 20 mg/kg, with about 5 µg/kg to about 10 mg/kg particularly preferred. It will be evident to those skilled in the art that the number and frequency of administration will be dependent upon the response of the host.

The pharmaceutical compositions of this disclosure may be in any form that allows for administration to a patient, such as, for example, in the form of a solid, liquid, or gas (aerosol). The composition may be in the form of a liquid, e.g., an elixir, syrup, solution, emulsion or suspension, for administration by any route described herein.

A liquid pharmaceutical composition as used herein, whether in the form of a solution, suspension or other like form, may include one or more of the following components: sterile diluents such as water for injection, saline solution (e.g., physiological saline), Ringer's solution, isotonic sodium chloride, fixed oils such as synthetic mono- or diglycerides that may serve as the solvent or suspending medium, polyethylene glycols, glycerin, propylene glycol or other solvents; antibacterial agents such as benzyl alcohol or methyl paraben; antioxidants such as ascorbic acid or sodium bisulfite; buffers such as acetates, citrates or phosphates; chelating agents such as ethylenediaminetetraacetic acid; and agents for the adjustment of tonicity such as sodium, chloride, or dextrose. The parenteral preparation can be enclosed in ampoules, disposable syringes or multiple dose vials made of glass or plastic. Physiological saline is a preferred additive. An injectable pharmaceutical composition is preferably sterile.

It may also be desirable to include other components in the preparation, such as delivery vehicles including aluminum salts, water-in-oil emulsions, biodegradable oil vehicles, oil-in-water emulsions, biodegradable microcapsules, and liposomes. Examples of adjuvants for use in such vehicles include N-acetylmuramyl-L-alanine-D-isoglutamine (MDP), lipopolysaccharides (LPS), glucan, IL-12, GM-CSF, γ-interferon, and IL-15.

While any suitable carrier known to those of ordinary skill in the art may be employed in the pharmaceutical compositions of this disclosure, the type of carrier will vary depending on the mode of administration and whether a sustained release is desired. For parenteral administration, the carrier may comprise water, saline, alcohol, a fat, a wax, a buffer, or any combination thereof. For oral administration, any of the above carriers or a solid carrier, such as mannitol, lactose, starch, magnesium stearate, sodium saccharine, talcum, cellulose, glucose, sucrose, magnesium carbonate, or any combination thereof, may be employed.

Also contemplated is the administration of multi-specific fusion protein compositions of this disclosure in combination with a second agent. A second agent may be one accepted in the art as a standard treatment for a particular disease state, such as inflammation, autoimmunity, and cancer. Exemplary second agents contemplated include cytokines, growth factors, steroids, NSAIDs, DMARDs, chemotherapeutics, radiotherapeutics, or other active and ancillary agents.

This disclosure contemplates a dosage unit comprising a pharmaceutical composition of this disclosure. Such dosage units include, for example, a single-dose or a multi-dose vial or syringe, including a two-compartment vial or syringe, one comprising the pharmaceutical composition of this disclosure in lyophilized form and the other a diluent for reconstitution. A multi-dose dosage unit can also be, e.g., a bag or tube for connection to an intravenous infusion device.

This disclosure also contemplates a kit comprising a pharmaceutical composition in a unit dose or multi-dose container, e.g., a vial, and a set of instructions for administering the composition to patients suffering a disorder as described herein.

All U.S. patents, U.S. patent application publications, U.S. patent applications, foreign patents, foreign patent applications, non-patent publications, tables, sequences, webpages, or the like referred to in this specification, are incorporated herein by reference, in their entirety. The following examples are intended to illustrate, but not limit, this disclosure.

EXAMPLES

Xceptor Sequences

Nucleotide expression cassettes and amino acid sequences of exemplary multi-specific fusion proteins having a CTLA4 ectodomain are provided in SEQ ID NOS:8, 12, 16, 23, 27, 30, 34, 37 and 41 and SEQ ID NOS:9, 13, 17, 24, 28, 31, 35, 38, and 42, respectively. The activity of these exemplary multi-specific fusion proteins was tested as described in Examples 1-6 below. Abbreviations used in the following examples include the following terms: PBS-T: PBS, pH 7.2-7.4 and 0.1% Tween®20; Working buffer: PBS-T with 1% BSA; Blocking buffer: PBS-T with 3% BSA.

Example 1

Anti-CD86 Binding Domains

Hybridomas 3D1 and FUN1 were used to clone the anti-CD86 variable binding domains of these monoclonal antibodies. The sequences for the heavy chain, light chain, scFv linker, and CDRs from the FUN1 and 3D1 anti-CD86 monoclonal antibodies are found in SEQ NOS:305-313 and 318-326, respectively.

The following humanized FUN1 anti-CD86 monoclonal antibody variable binding domains were used to construct SMIP proteins and xceptors. The FUN1 CDRs were grafted into human germline sequences as follows: (1) FUN1-11 has Igkv4-1*01 FR for light chain and IgHV1-F*01 FR for heavy chain; (2) FUN1-21 has Igkv4-1*01 FR for light chain and IgHV1-2*02 FR for heavy chain; (3) FUN1-31 has Igkv4-1*01 FR for light chain and IgHV3-11*01 FR for heavy chain; (4) FUN1-12 has Igkv1-27*01 FR for light chain and IgHV1-F*01 FR for heavy chain; (5) FUN1-22 has Igkv1-27*01 FR for light chain and IgHV1-2*02 FR for heavy chain; and (6) FUN1-32 has Igkv1-27*01 FR for light chain and IgHV3-11*01 FR for heavy chain. The germline CDRs for the humanized molecules are similar to the original FUN1 molecules.

Figure 7:
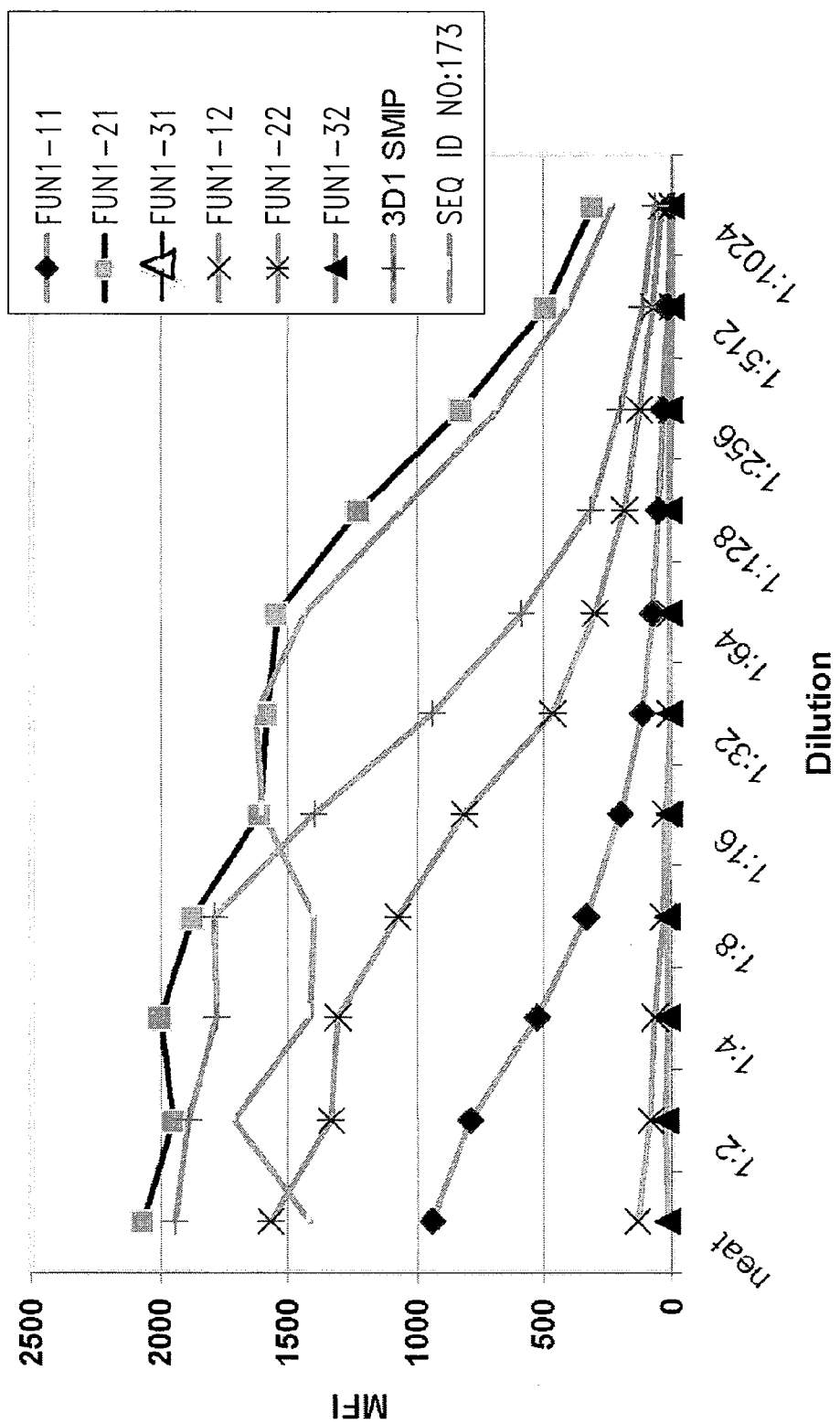
FIG. 7 shows that various different versions of humanized anti-CD86 FUN1 SMIPs can bind CD86.
Figure 8:
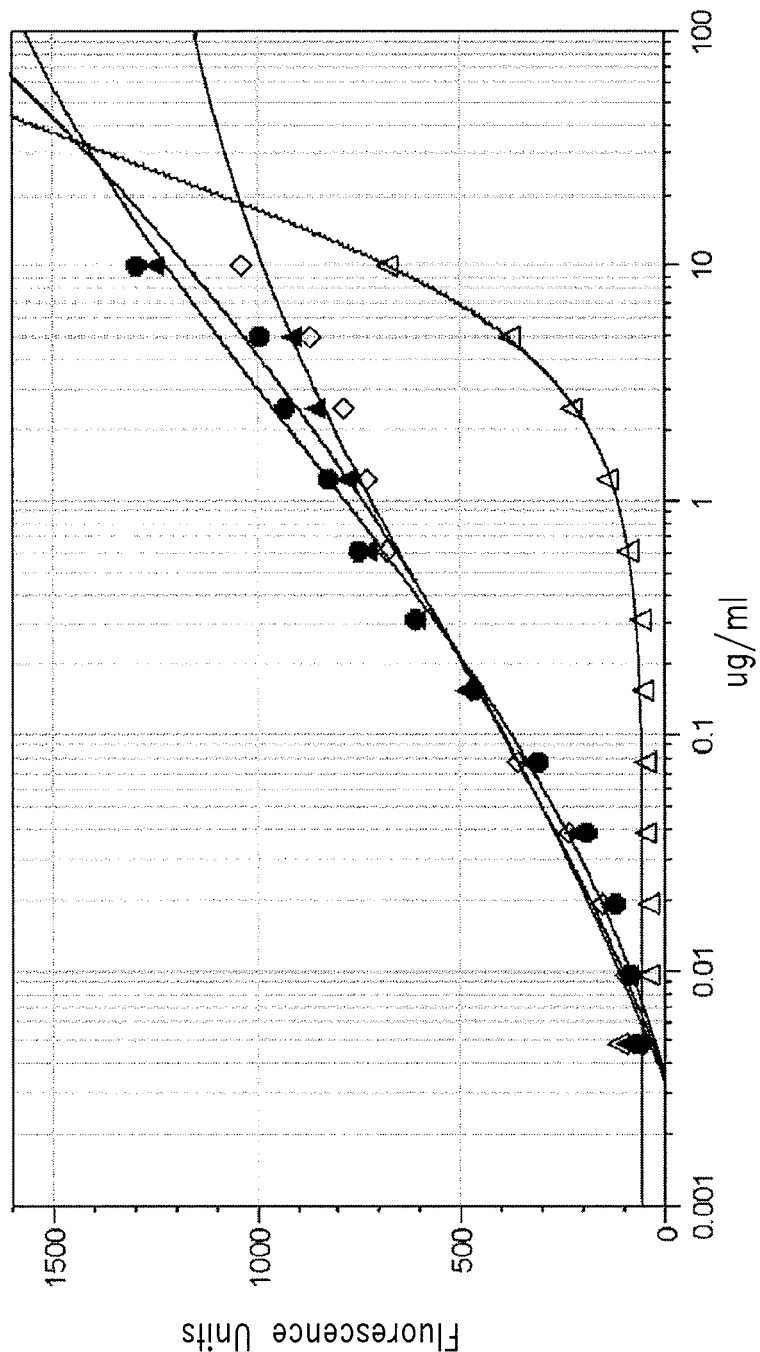
FIG. 8 shows that CTLA4::IL10 xceptor molecules having various linkers joining IL10 to the carboxy-terminus (BD2) of the xceptor can bind IL10R1-Ig. ▲-SEQ ID NO:9; ◇-SEQ ID NO: 171; ●-SEQ ID NO:302; ▲-SEQ ID NO:173.
Figure 9:
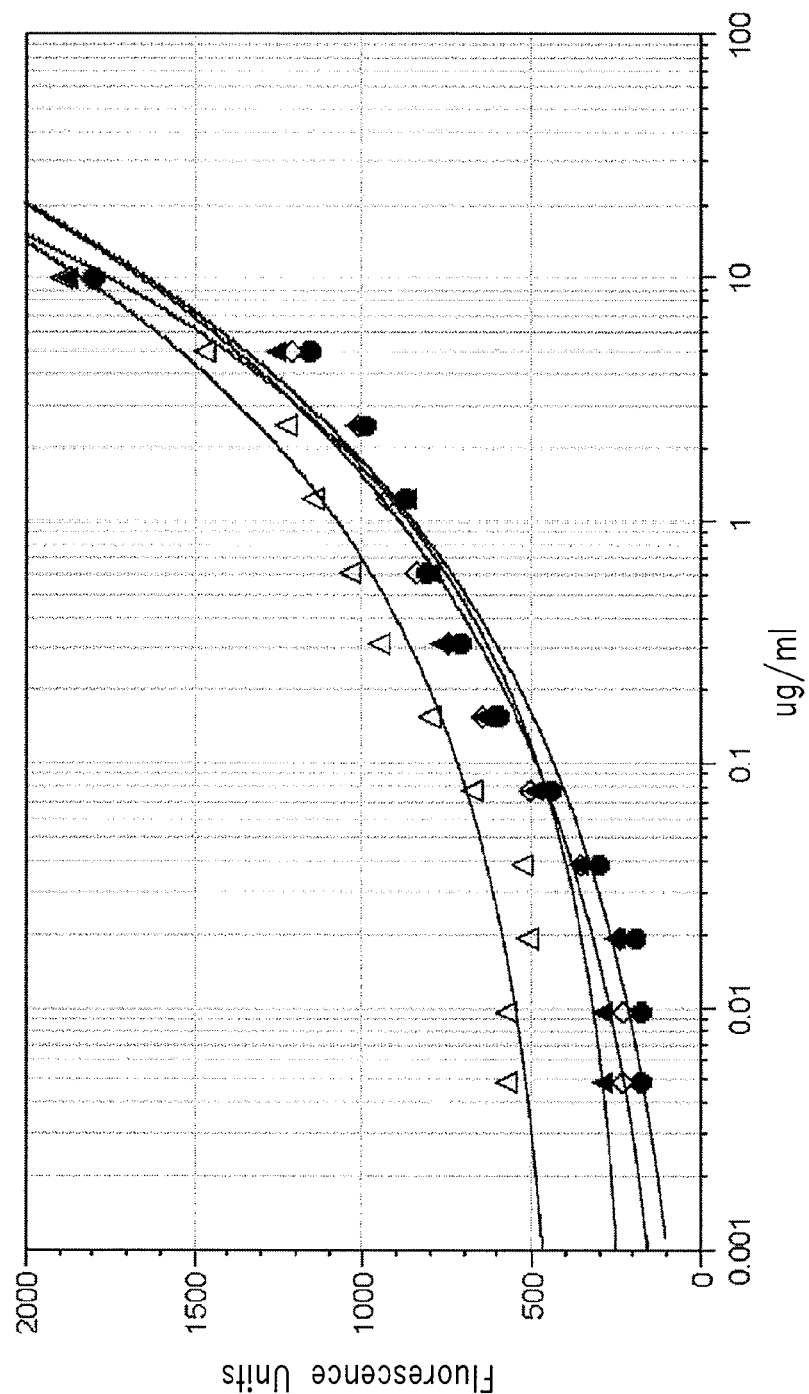
FIG. 9 shows that CTLA4::IL10 xceptor molecules having shorter linkers joining IL10 to the carboxy-terminus (BD2) of the xceptor can bind IL10R1-Ig. ▲-SEQ ID NO:171; ◇-SEQ ID NO:175; ●-SEQ ID NO:177; ▲-SEQ ID NO:179.
Figure 10:
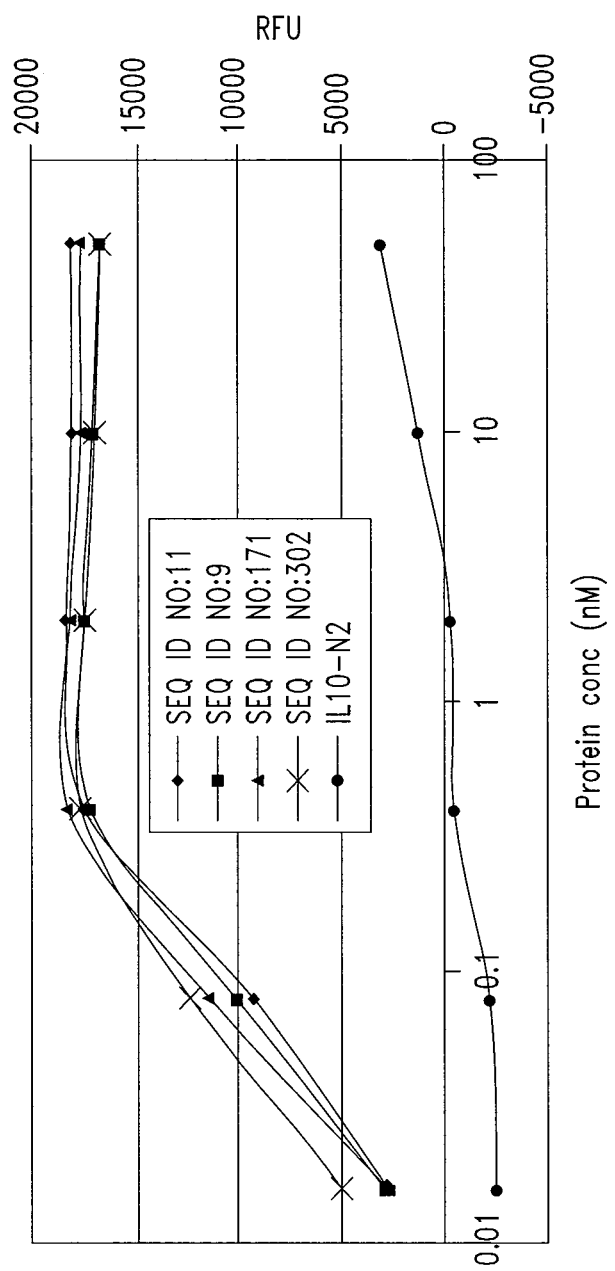
FIG. 10 shows that several xceptor proteins bind to CD80.
Figure 11:
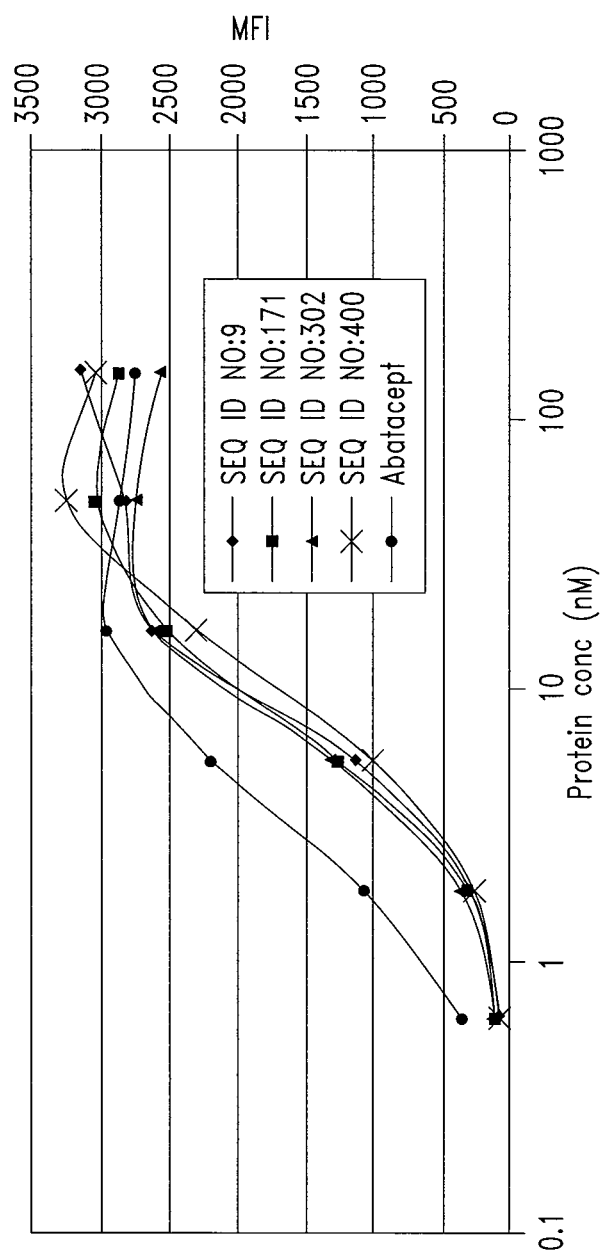
FIG. 11 shows that several xceptor proteins bind to CD86.
Figure 12:
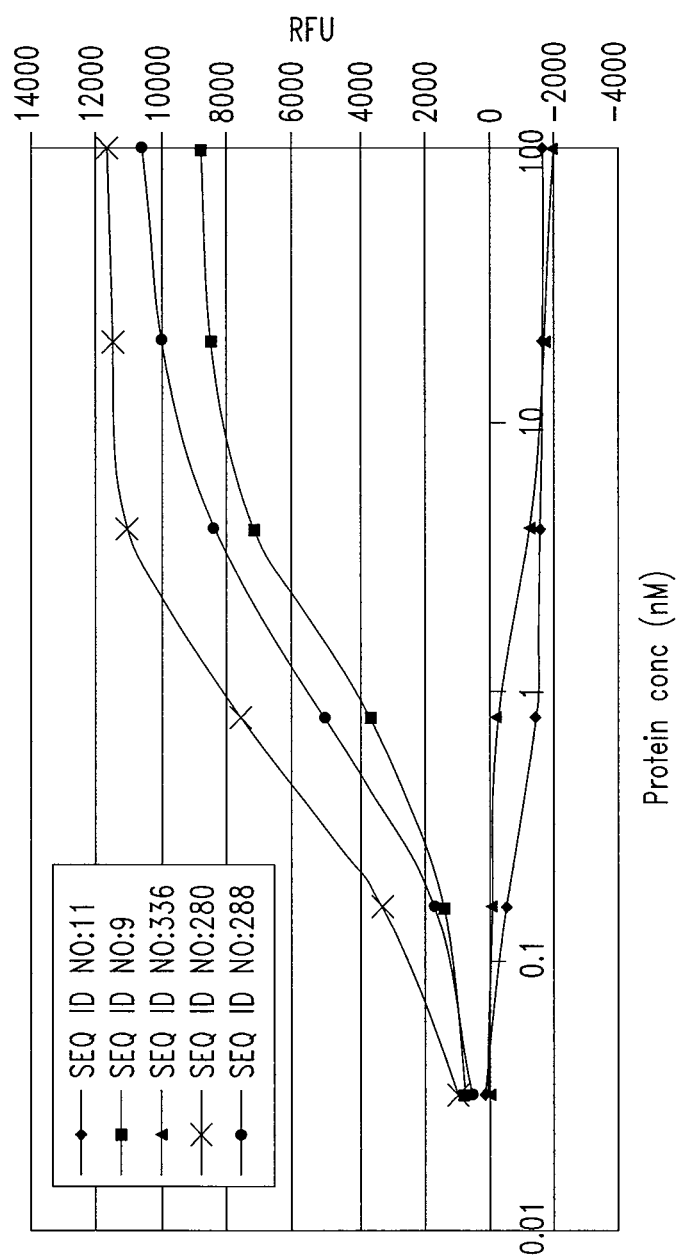
FIG. 12 shows that several xceptor proteins bind to sIL10Ra.
Figure 13:
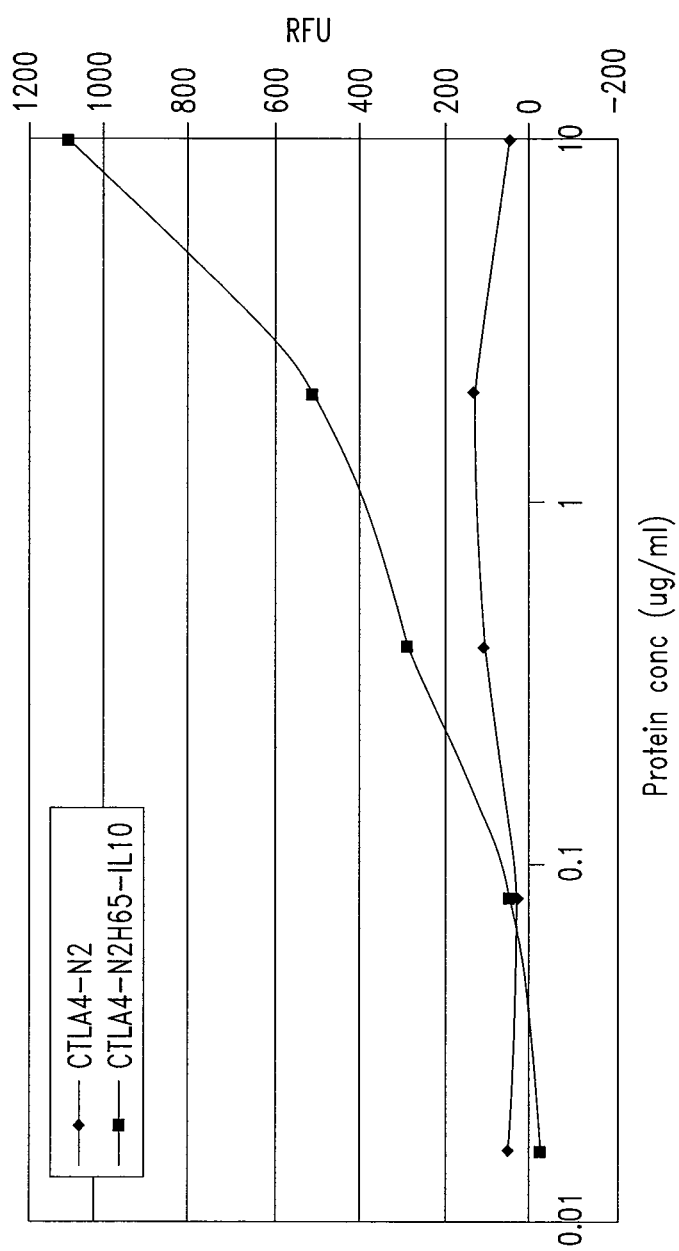
FIG. 13 shows that several xceptor proteins can simultaneously bind to CD80 and sIL10Ra.
Figure 14:
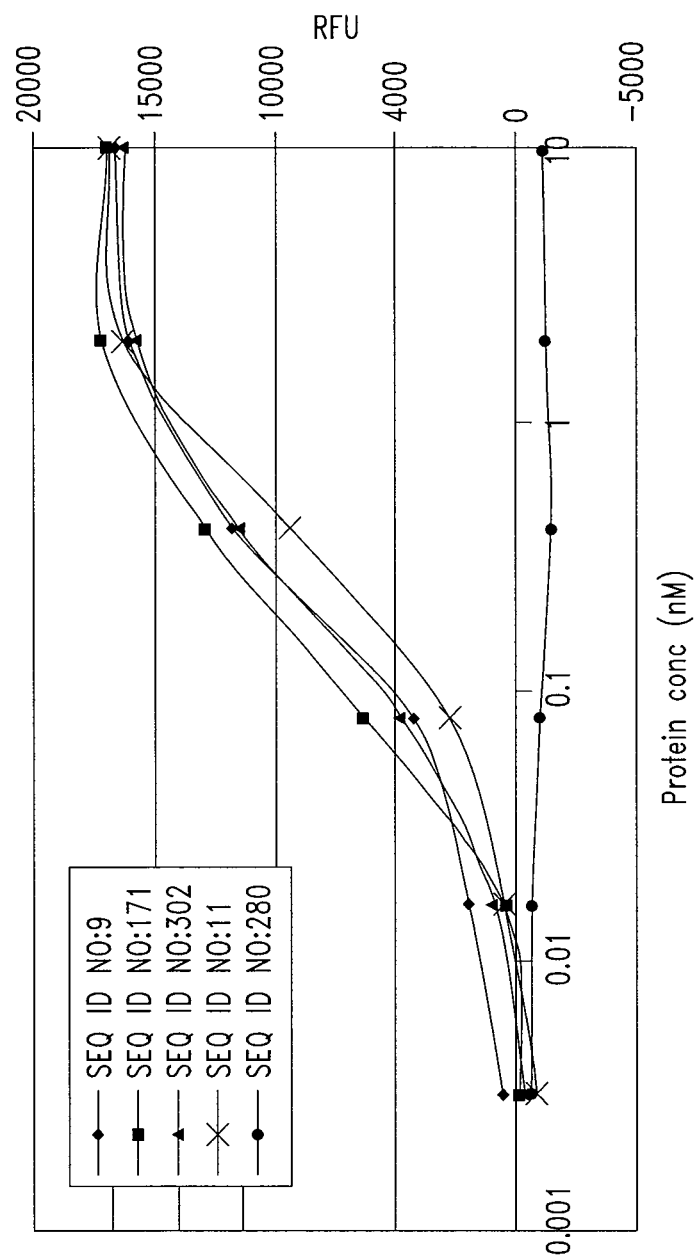
FIG. 14 shows that several xceptor proteins are crossreactive with mouse CD80.
Figure 15:
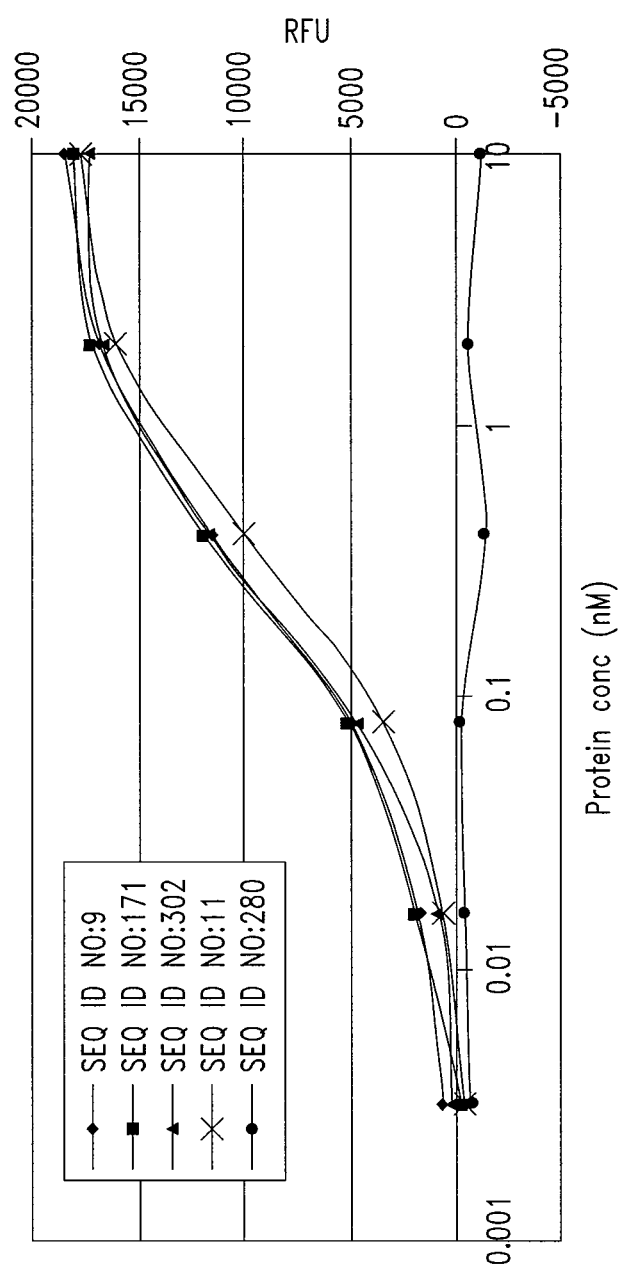
FIG. 15 shows that several xceptor proteins are crossreactive with mouse CD86.
Figure 16:
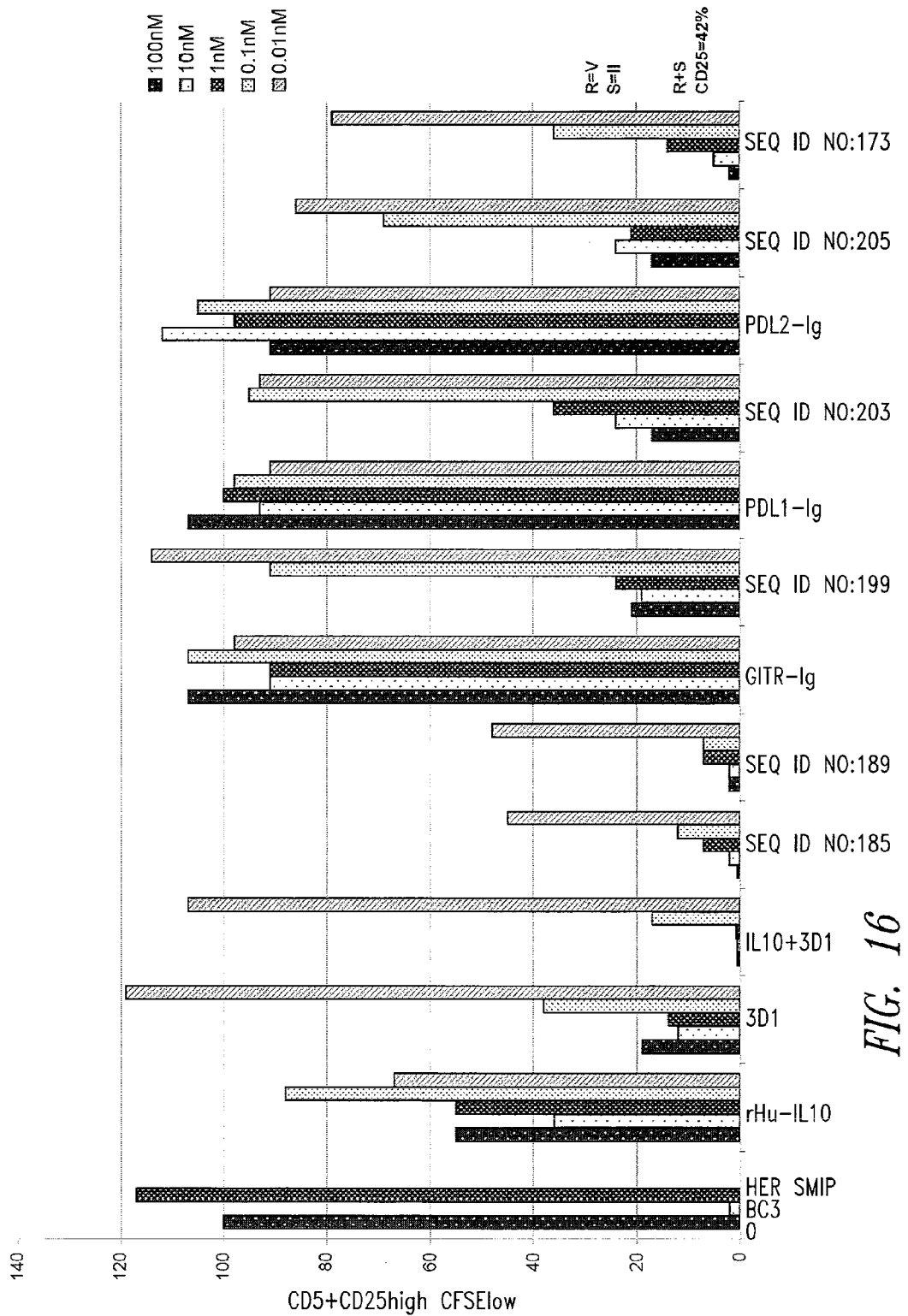
FIGS. 16 and 17 show that several xceptor proteins block a human T cell response in an MLR assay.
Figure 17:
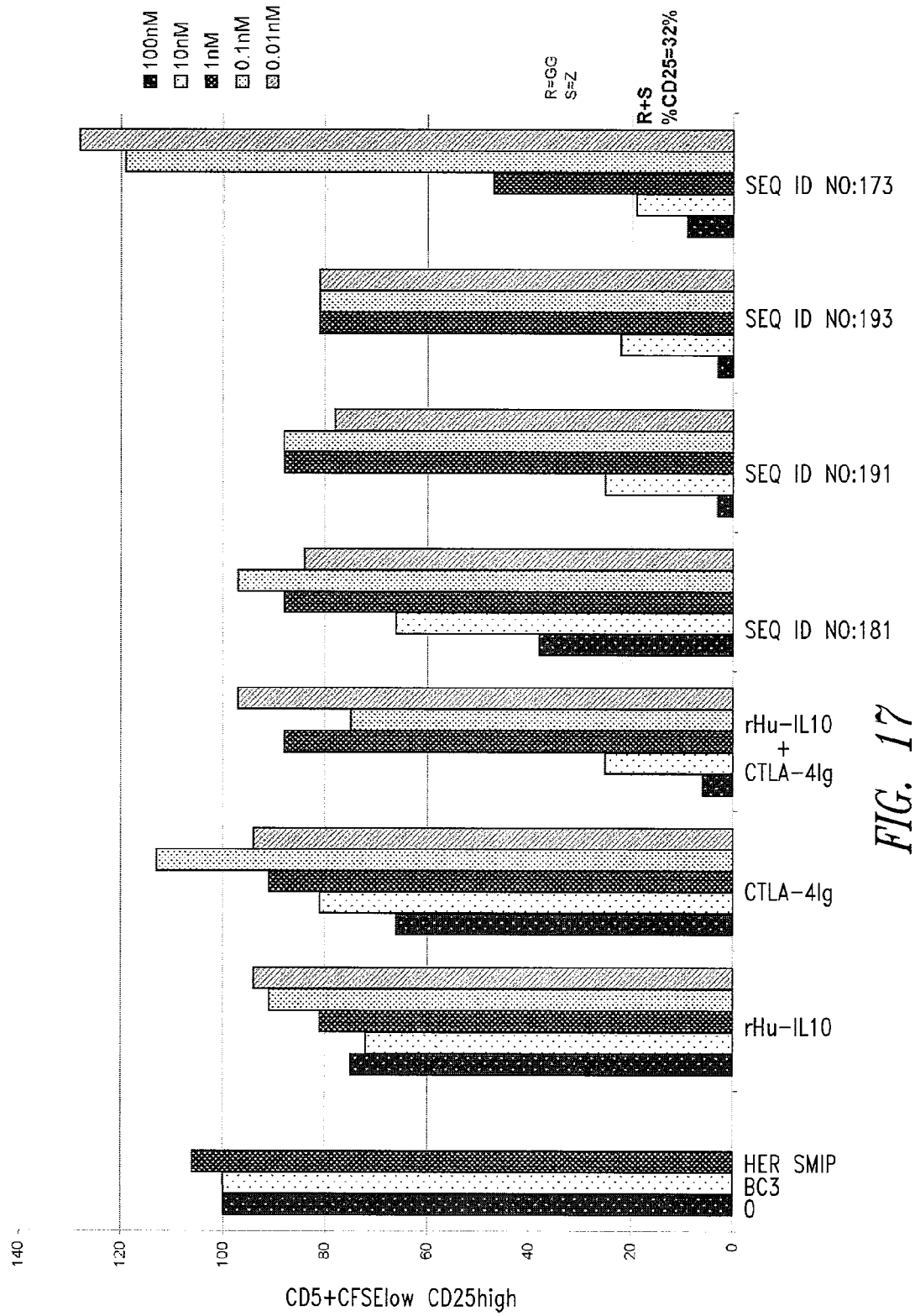

Consequently, six versions of humanized FUN1 SMIP proteins were also generated as follows: (1) FUN1-11 (SEQ ID NO:225); (2) FUN1-21 (SEQ ID NO:227); (3) FUN1-31 (SEQ ID NO:229); (4) FUN1-12 (SEQ ID NO:231); (5) FUN1-22 (SEQ ID NO:233); and (6) FUN1-32 (SEQ ID NO:235). Binding activity of these humanized FUN1 SMIP molecules is shown in FIG. 7. In addition, the FUN1 variable domains (scFv) and humanized FUN1 scFv were used to make xceptors, such as IL10::FUN1 (SEQ ID NO:183); FUN1::IL10 (SEQ ID NO:187); FUN1-21::IL10 (SEQ ID NO:237); IL10::FUN1-21 (SEQ ID NO:254); IL10 I87A::FUN1-21 (SEQ ID NO:258); and monoIL10::FUN1-21 binding domain was also made using a short A2 hinge (SEQ ID NO:276) (wherein the A2 hinge amino acid sequence is set forth in SEQ ID NO:364).

These, and all the other constructs described herein, were cloned into appropriate mammalian expression vectors and expressed in various cell lines to produce protein for particular functional assays.

Example 2

Xceptor Binding to IL10-R1 by BIAcore™

IL10-R1 binding activity was examined for an Xceptor including a CTLA4 ectodomain and an IL10 domain (SEQ ID NO:9), substantially as follows.

Surface plasmon resonance (SPR) measurements were performed on a BIAcore™ T100 SPR (Pharmacia Biotech AB, Uppsala) using HBS-P+ (GE Healthcare) as a running buffer. IL-10R1 (25 µg/mL in 10 mM sodium acetate, pH 4.0; R&D Systems) was directly immobilized onto a CM5 chip using standard amine coupling chemistry (Biacore Amine Coupling Kit, GE Healthcare), with final immobilization levels of 867, 2687, and 6719 Ru (resonance units). IL-10-containing constructs were injected for 300 seconds, at a flow rate of 50 µl/min, in a series of concentrations from 100 pM to 10 nM. Dissociation was monitored for 1200 seconds, and the surface was regenerated by injecting 2 M magnesium chloride, pH 7.58, for 60 seconds, followed by injecting 20 mM EDTA (in HBS-P+) for 60 seconds. Binding interactions with the surface were stable through at least 30 regeneration cycles. Data were analyzed using BiaEvaluation for the T100, version 2.0 (GE Healthcare). Binding kinetics of the CTLA4/IL10 Xceptor to immobilized IL-10R1 could not be fit to a 1:1 Langmuir binding model, but could be fit with high accuracy to a bivalent analyte binding model. Equilibrium dissociation constants ($K_D$) could be calculated with high accuracy for each construct by fitting the observed response at saturation to a steady-state equilibrium model, and are provided below in Table 3. Inclusion of the CTLA4 ectodomain in the Xceptor fusion protein had no apparent effect on the IL10/IL10R1 interaction.

TABLE 3

| Immobilized Protein | Analyte | First Site $k_a$ ($M^{-1}s^{-1}$) | First Site $k_d$ ($s^{-1}$) | Second Site $k_a$ ($s^{-1}$) | Second Site $k_d$ ($s^{-1}$) | $K_D$ (nM) |
|---|---|---|---|---|---|---|
| IL10-R1 | IL10* | $5.7 \times 10^5$ | $2.6 \times 10^{-4}$ | — | — | 0.46 |
| IL10-R1 | SEQ ID NO: 9 | $7 \times 10^5$ | $2.9 \times 10^{-4}$ | $18 \times 10^{-3}$ | $8.6 \times 10^{-3}$ | 0.41** |

*Literature value (Yoon et al. (2006) J. Biol. Chem 281: 35088-35096)
**Calculated from $k_a1$ and $k_d1$

Example 3

Xceptor Binding to CD80 and Both CD80 and IL10 by ELISA

CD80 and IL10R binding activity was examined by ELISA for abatacept, a CTLA4-Ig construct referred to as CTLA4-N2 (SEQ ID NO: 10 and 11), and the CTLA4/IL10 Xceptor of SEQ ID NO: 9, substantially as follows.

CD80 Binding

Each well of a 96-well black Maxisorp CD80 plate (Nunc Catalog #437111) plate was coated with CD80-mIg (Ancell Catalog #510-020) at 2 µg/ml solution and incubated overnight at 4° C. The plate was then blocked with Blocking Buffer (PBS-T with 3% non-fat dry milk). Samples of the proteins to be tested serially diluted Blocking Buffer were added in duplicate wells to the CD80-mIg coated plate, the plate was covered, and incubated at room temperature for about 1 hour. After washing, 100 µl per well horse radish peroxidase goat anti-human IgG (gamma) diluted 1:1,000 in Blocking Buffer was added, the plate was covered, and incubated at room temperature for 60 minutes, followed by a 10 minute incubation at room temperature in QuantaBlu™ Fluorogenic Peroxidase Substrate (Thermo Scientific Catolog #15169). The absorbance of each well was read at 420 nm. The unrelated fusion protein TRU-015 was employed as a negative control.

The results of these experiments are shown in FIG. 1. CTLA4-N2 was found to bind as well as abatacept to CD80-mIg in this ELISA format, while the CTLA4/IL10 Xceptor appeared to show weaker CD80 binding.

Xceptor Binding to both sIL10R1 and sCD80

Each well of a 96-well black Maxisorp CD80 plate (Nunc Catalog #437111) plate was coated with sIL10Ra (R&D Systems Catalog #510-020) at 2 µg/ml solution and incubated overnight at 4° C. The plate was then blocked with Blocking Buffer (PBS-T with 3% non-fat dry milk). Samples of the proteins to be tested serially diluted Blocking Buffer were added in duplicate wells to the sIL10Ra coated plate, the plate was covered, and incubated at room temperature for about 1 hour. After washing, anti-CD152 antibody (Ancell #359-020) at 10 ng/ul or CD80-mIg (Ancell #510-020) at 5 ug/ml was added followed by horse radish peroxidase goat anti-mouse IgG (Fc) (Pierce #31439) diluted 1:10,000 in Blocking Buffer was added, the plate was covered, and incubated at room temperature for 60 minutes, followed by a 10 minute incubation at room temperature in QuantaBlu™ Fluorogenic Peroxidase Substrate (Thermo Scientific Catolog #15169). The absorbance of each well was read at 420 nm. The unrelated fusion protein TRU-015 was employed as a negative control.

Figure 2:
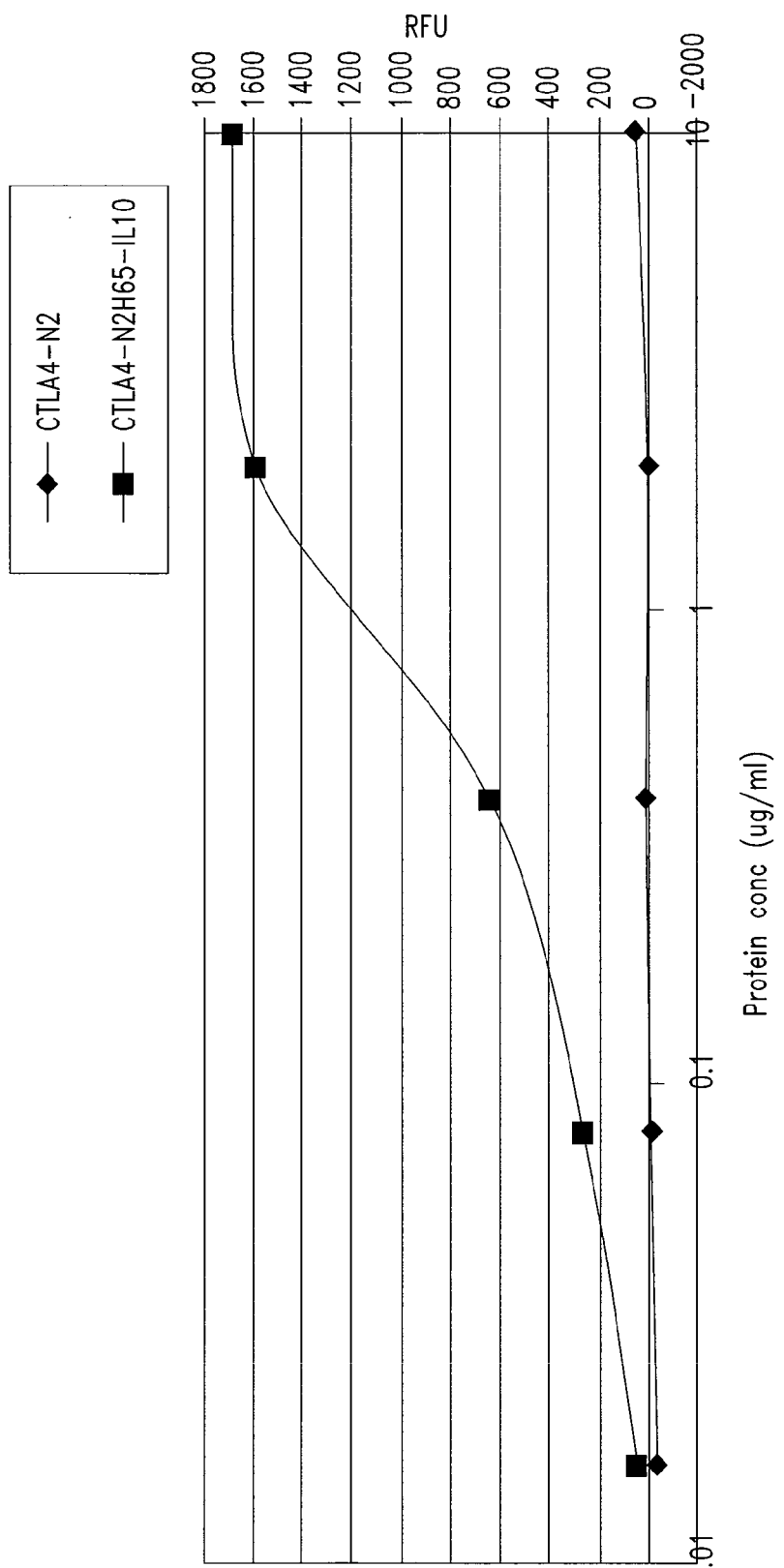
FIG. 2 shows that CTLA4-Ig(N2) (SEQ ID NO:11) and a multi-specific xceptor fusion protein containing a CTLA4 ectodomain fused to an IL10 (SEQ ID NO:9) can bind to soluble IL10Ra (sIL10Ra).

FIG. 2 shows the results obtained for CTLA4-N2 and the CTLA4::IL10 xceptor of SEQ ID NO: 9. These results demonstrate that both the CTLA4 and IL10 domains of the CTLA4-Ig-IL10 Xceptor are able to bind to their ligand/receptor simultaneously.

Example 4

Xceptor Induced Stat3 Phosphorylation

Binding of IL10 to IL10-R1 is known to activate Jak-1 and Tyk which in turn lead to activation of STAT3 (see, for example, Williams et al. (2007) J. Biol. Chem. 282:6965-6975). In addition, studies have demonstrated that flow cytometry may be employed to study the phosphorylation of STAT3 in PBMC (Lafarge et al. (2007) BMC Mol. Biol. 8:64). The ability of various IL10-containing constructs, including the CTLA4/IL10 Xceptor of SEQ ID NO: 9, to induce phosphorylation of STAT3 in human PBMC was examined substantially as follows.

PBMCs were isolated from a human donor and cultured overnight in complete media (RPMI, 10% FBS, pen/strep) at $2\times10^6$ cells/ml. The following morning, the PBMCs were washed once, resuspended with pre-warmed RPMI 1640 (no supplements) at $4\times10^6$ cells/ml and incubated at 37° C. for 2.5 hrs. Treatments were prepared at a 2× concentration in 0.25 mL of RPMI 1640 and mixed with $1\times10^6$ PBMCs in 0.25 mL of RPMI 1640. The samples were then incubated for 15 min at 37° C. Upon completion of the 15 min incubation, 0.5 mL of ice cold BD Cytofix Buffer (BD Biosciences, cat #554655) was added to each tube. Cells were incubated on ice for 30 min and then washed with 2 mls of DPBS+2.5% FBS (FACS Buffer). After decanting and vortexing the samples, 0.5 mL of ice cold BD PERM BUFFER III (BD Biosciences, cat #558050) was added to each tube and the samples were then incubated on ice for 30 min. Samples were washed 3× with 2 mL of FACS Buffer, and resuspended in ~0.2 mL of FACS buffer after the final wash. 20 uL of FITC conjugated anti-Human STAT3 mAb (BD Biosciences, clone PY705) was added to each sample. Cells were incubated in the dark at room temperature for 30 min. Samples were then washed 3× with FACS Buffer to remove any unbound antibody. Samples were analyzed on a LSRII flow cytometer. A gate was applied to live lymphocytes based on SSC and FSC profiles and MFI for FITC was determined.

Figure 3:
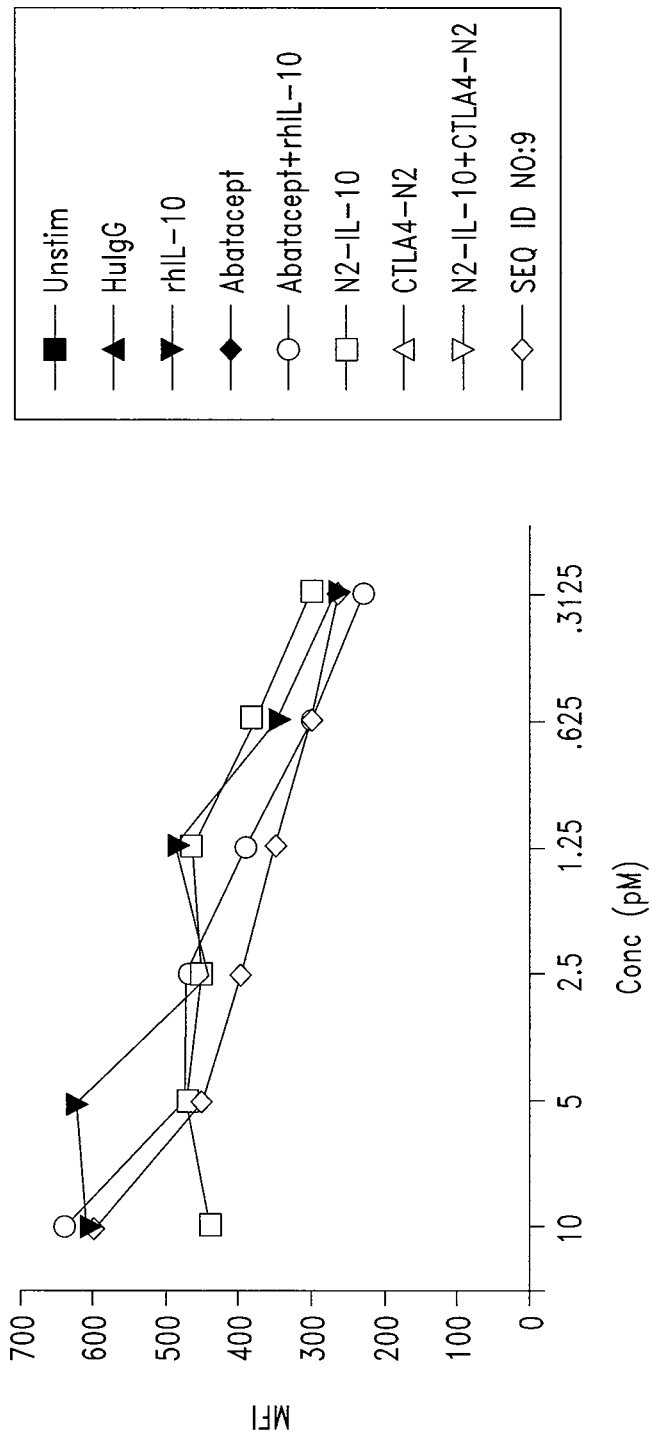
FIGS. 3 and 4 show that a multi-specific xceptor fusion protein containing a CTLA4 ectodomain fused to an IL10 (SEQ ID NO:9) can induce STAT3 phosphorylation in PBMC.
Figure 4:
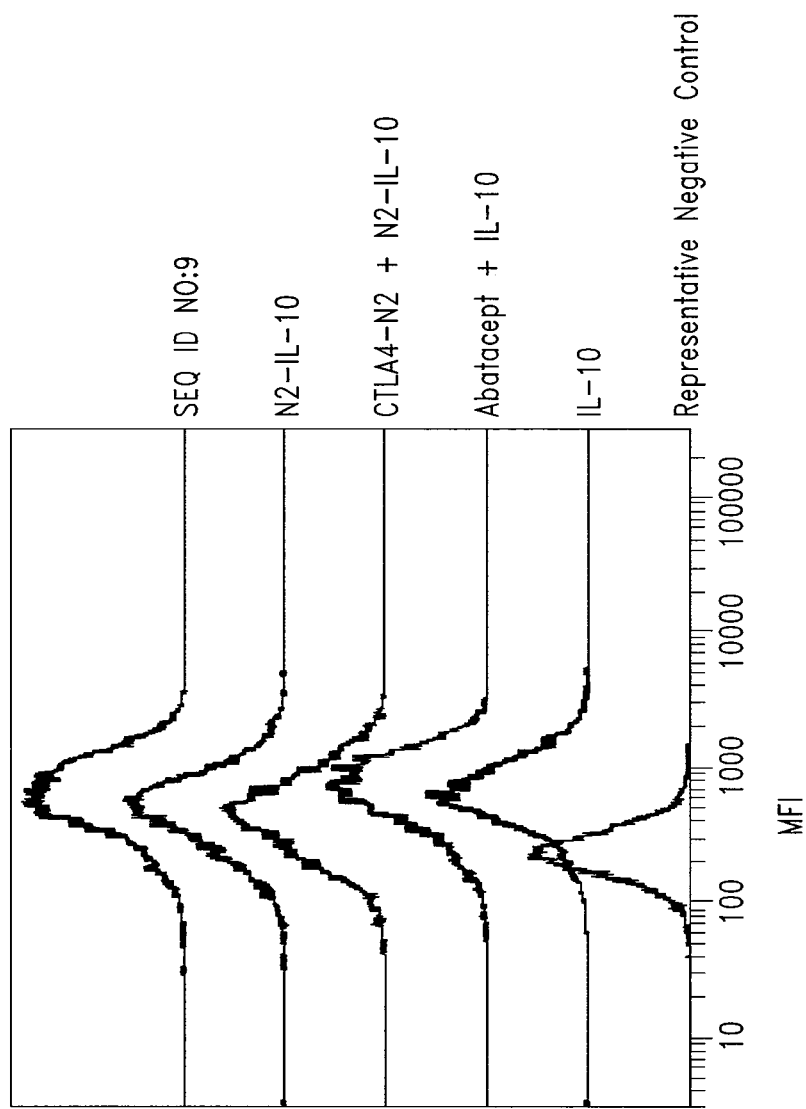

As shown in FIG. 3 and FIG. 4, all IL-10 containing constructs increased STAT3 phosphorylation in a dose dependent fashion.

Example 5

Xceptor Binding to CD86 and Both CD86 and IL10

A human B-lymphoblastoid cell line that expresses CD86 (WIL2-S) was used to examine CD86 binding, and a CHO cell line expressing CD86 (HuCD86-2A2 cells) on the surface was used in combination with soluble IL10 Receptor1 (IL10R1) fusion protein linked to a murine IgG Fc or an anti-IL10 antibody to examine the simultaneous binding of the CD86 antagonist and IL10 agonist found on xceptor molecules. Briefly, WIL2-S or HuCD86-2A2 cells were incubated with test molecules containing a CD86 antagonist at concentrations ranging from saturation to background levels. To the HuCD86-2A2 cells, an IL10R1-muIg fusion protein or a murine anti-IL10 antibody was further added to form a complex with the test molecules that had bound to the cell surface via CD86. After the incubation, cells were washed and a fluorophore (R-phycoerythrin) tagged F(Ab')$_2$ antibody specific for the Fc portion of the xceptor molecule, IL10R-Ig fusion protein, or anti-IL10 antibody. The tagged cells were then passed through a flow cytometer and data was analyzed by plotting median fluorescence intensity of each sample.

Figure 5:
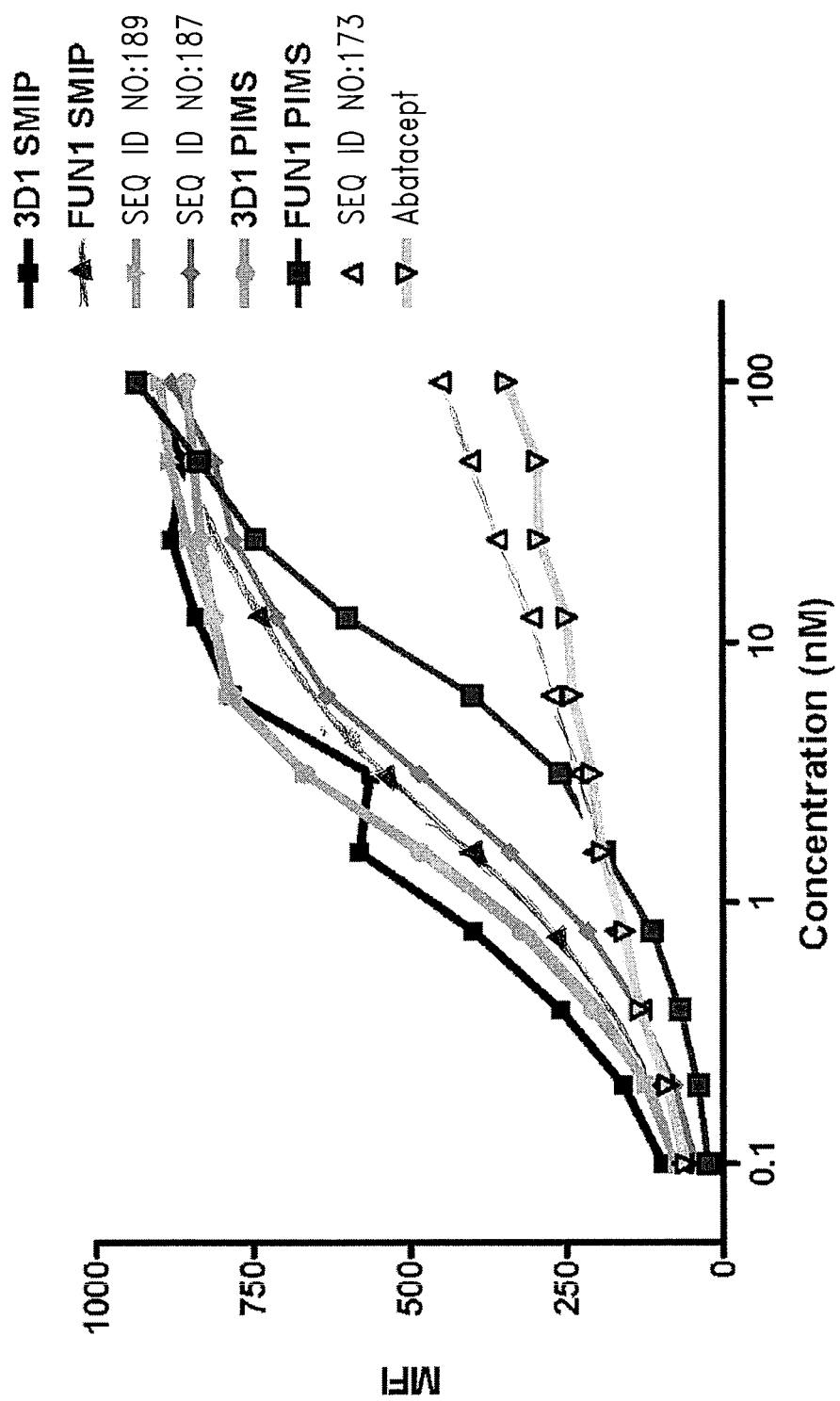
FIG. 5 shows that xceptors containing anti-CD86 binding domains from 3D1 and humanized FUN1 monoclonal antibodies bind to CD86 on WIL2-S cells.

As shown in FIG. 5, binding to CD86 on WIL2-S cells by xceptor molecules containing an anti-CD86 binding domain (e.g., from hybridoma antibodies 3D1 and FUN1) showed higher affinity than binding of CTLA4 ectodomain containing xceptor molecules. More specifically, anti-CD86 3D1 containing xceptor 3D1::IL10 (SEQ ID NO:189) had slightly higher affinity to CD86 than anti-CD86 FUN1 containing xceptor FUN1::IL10 (SEQ ID NO:187), whereas CTLA4-Ig (SEQ ID NO:11) and a CTLA4 containing xceptor (SEQ ID NO:173) had much lower affinity for CD86 than the anti-CD86 binding domains from hybridoma antibodies 3D1 and FUN1.

Figure 6:
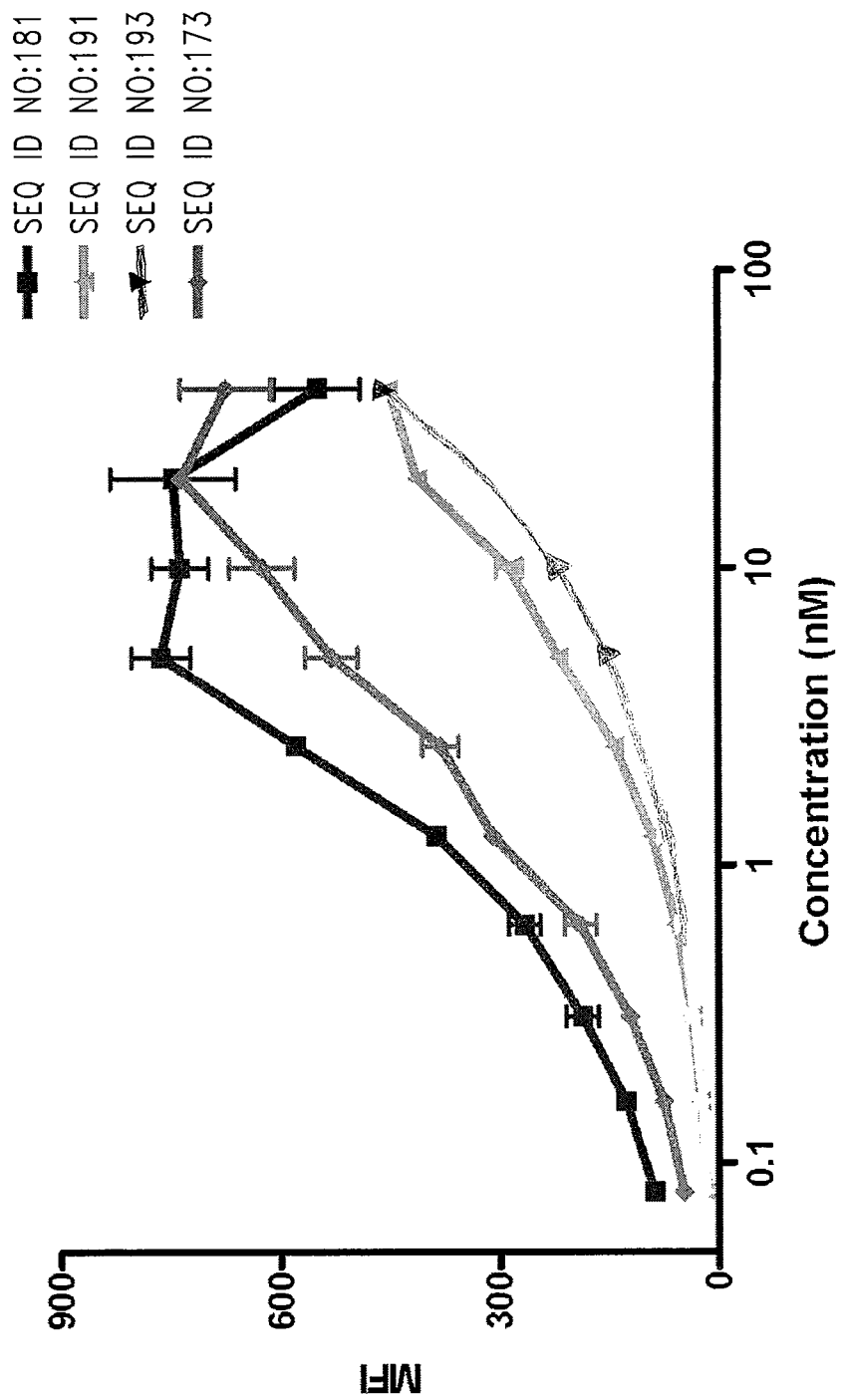
FIG. 6 shows that an xceptor containing a CD86 binding domain and IL10 can simultaneously bind cell surface CD86 and sIL10Ra.

As shown in FIG. 6, xceptor molecules containing a CD86 antagonist and IL10 agonist could simultaneously bind CD86 on HuCD86-2A2 cells (CHO cells expressing CD86 on cell surface developed in house) and soluble IL10R1. Furthermore, FIG. 6 shows that the IL10 variants had different binding affinities for IL10R1. For example, the xceptor molecules CTLA4::monoIL10 (SEQ ID NO:181) and (CTLA4::IL10)-75 (SEQ ID NO:173) had similar affinities for IL10R1, but the xceptors containing the viral mutated IL10 form, CTLA4::IL10I87A (SEQ ID NO:191) and CTLA4::IL10I87S (SEQ ID NO:193), showed much lower affinity for IL10R1.

In another experiment, different versions of humanized FUN1 SMIPs were tested for CD86 binding. Supernatants of HEK293 cells transiently transfected with the six different versions of humanized FUN1 SMIPs were examined for CD86 binding using HuCD86-2A2 cells. FIG. 7 shows that that FUN1-21 (SEQ ID NO:227) had the best binding affinity to CD86 followed by FUN1-22 (SEQ ID NO:233) and then FUN1-11 (SEQ ID NO:225); the remaining humanized FUN1 SMIP proteins (FUN1-12, SEQ ID NO:229; FUN1-31, SEQ ID NO:231; FUN1-32, SEQ ID NO:235) did not show detectable binding.

Example 7

Serum Stability and Pharmacokinetics of Xceptor Proteins

The serum stability of (CTLA4::IL10)-75 (SEQ ID NO:173) was tested. In this experiment, purified protein of SEQ ID NO:173 was treated in mouse serum at 37° C. for 24 hours, 72 hours and F/T (freeze/thaw) and spike in at the time of assay (TO). All stability samples were tested for their binding to CD80 (using CD80 expressing 1F6 CHO cells) as well as for simultaneous binding to CD80 and anti-IL10 antibody binding to IL10 on the xceptor. The results showed that SEQ ID NO:173 was very stable and retained anti-IL10 binding after incubation in mouse serum at the tested concentrations (from about 0.01 nM to about 10 nM).

Pharmacokinetic (PK) studies for (CTLA4::IL10)-68 (SEQ ID NO:171) and (CTLA4::IL10)-75 (SEQ ID NO:173) were conducted in female Balb/c mice, using 3 mice per time point. Mice were injected intravenously with 200 μg/mouse. Mouse serum was collected at 15 minutes, 2 hours, 6 hours, 24 hours, 48 hours, 96 hours, 7 days and 14 days after treatment. Samples were tested for CD80 binding (CTLA4 assay) and simultaneous binding to CD80 and anti-IL10 antibody (IL10 assay). The results are summarized in Table 4 below.

TABLE 4

| PK Study Summary | | | | | | |
|---|---|---|---|---|---|---|
| PK Estimates for Abatacept, (CTLA4::IL10)-68 and (CTLA4::IL10)-75 | | Abatacept Estimates | (CTLA4::IL10)-68 PK Parameter Estimates | | (CTLA4::IL10)-75 PK Parameter Estimates | |
| | | CTLA4 | CTLA4 | IL-10 | CTLA4 | IL-10 |
| Parameter | Units | Assay | Assay | Assay | Assay | Assay |
| HL_Lambda_z | hr | 45.49 | 32.62 | 29.36 | 34.59 | 31.48 |
| Vz_obs | mL/kg | 117.30 | 84.571 | 158.57 | 206.48 | 285.30 |
| Cl_obs | mL/hr/kg | 1.79 | 1.797 | 3.74 | 4.14 | 6.28 |

Example 6

Varying Binding Domain Linker Lengths in Xceptor Proteins

Linker stability for CTLA4::IL10 molecules was examined. All linker variants were stably transfected in CHOK1SV cells and stable bulk populations were cultured at 37° C. and shifted to 34° C. on day 3. Proteins were purified by Protein A column and followed by second step SEC column. ELISA assays were performed to measure the IL10 binding to IL10R1-mIg fusion protein. The results in FIG. 8 showed that xceptor (CTLA4::IL10)-65 (SEQ ID NO:9) had reduced IL10 binding due to instability of the linker, but (CTLA4::IL10)-68 (SEQ ID NO:171), (CTLA4::IL10)-69 (SEQ ID NO:302), and (CTLA4::IL10)-75 (SEQ ID NO:173) were stable in these culture conditions.

Shorter linker variants were also tested in CTLA4::IL10 xceptor proteins for binding to IL10R1 by ELISA. The shorter linker variants were transiently transfected and proteins were Protein A column purified. ELISA assays were performed to measure the IL10 binding to IL10R1-mIg fusion protein. The results in FIG. 9 showed that the shorter linker variants (CTLA4::IL10)-77 (SEQ ID NO:175), Q0033 (CTLA4::IL10)-78 (SEQ ID NO:177), and (CTLA4::IL10)-79 (SEQ ID NO:179) worked as well as the longer linkers for back end IL10 binding affinity (e.g., compared to (CTLA4::IL10)-68; SEQ ID NO:171).

Example 8

Xceptor Binding to CD80, CD86 and IL10R1

CD80 and IL10R1 binding was examined by ELISA, and/or CD86 and IL10R1 binding was examined using CD86-expressing CHO cells and either IL10R1-Ig or anti-IL10. Binding to mouse CD80 and CD86 was examined by ELISA using biotin-labeled mouse antibodies. The molecules examined included the control CTLA4-Ig (SEQ ID NO:11) fusion protein, and the following test xceptor molecules: (CTLA4::IL10)-65 (SEQ ID NO:9); (CTLA4::IL10)-68 (SEQ ID NO:171); (CTLA4::IL10)-69 (SEQ ID NO:302), (CTLA4::PDL2)-65 (SEQ ID NO:336), substantially as described in Examples 3 and 5.

As shown in FIGS. 10 and 11, the (CTLA4::IL10)-65, (CTLA4::IL10)-68, and (CTLA4::IL10)-69 xceptor molecules all bound CD80 by ELISA and CD86 on cells. The results in FIG. 12 show that CTLA4::IL10 xceptor molecules can interact with huIL10R1. Further, as shown in FIG. 13, CTLA4::IL10 xceptors can engage both BD1 (amino-terminal binding domain) and BD2 (carboxy-terminal binding domain) simultaneously to CD80 and IL10R1 by ELISA. Additionally, FIGS. 14 and 15 show that the (CTLA4::IL10)-65, (CTLA4::IL10)-68, and (CTLA4:

IL10)-69 xceptor molecules, specific for human molecules, are capable of crossreacting with both mouse CD80 and mouse CD86.

Example 9

Xceptor Binding to CD80 by BIAcore™

CD80 binding activity was examined for abatacept (Orencia®, Bristol-Myers Squibb), a CTLA4-Fc fusion containing the L104E A29Y mutations, analogous to belatacept (SEQ ID NO:217), three CTLA4::IL10 xceptor linker variants each having a CTLA4 ectodomain and an IL10 domain: (CTLA4::IL10)-65 (SEQ ID NO:9), (CTLA4::IL10)-68 (SEQ ID NO:171), and (CTLA4::IL10)-75 (SEQ ID NO:173); an xceptor including a CTLA4 ectodomain with the L104E A29Y mutations and an IL10 domain (SEQ ID NO:219), and an xceptor containing a CTLA4 ectodomain and a PD-L1 domain (SEQ ID NO:13), substantially as described herein. Examination of binding of CTLA4-Fc to CD80/86 by BIAcore has been described previously (Greene et al. (1996) J. Biol. Chem. 271:26762-26771; van der Merwe et al. (1997) J. Exp. Med. 185:393-403; Collins et al. (2002) Immunity 17:201-210). Binding of CD80 by CTLA4 is of moderate affinity ($K_d$=~200 nM), and is characterized by a fast on rate ($4-8 \times 10^5$ $M^{-1}$ $s^{-1}$) and a moderate off rate (0.090 $s^{-1}$). Binding of dimeric CTLA4-Fc to CD80 is biphasic, and has been reported with two off-rates (0.004, 0.086 $s^{-1}$). The L104E A29Y mutations on CTLA4-Fc have been reported to increase the affinity for CD80 two-fold over the wild type CTLA4-Fc (Larsen et al (2005) Am. J. Transplant. 5:443-453), primarily by decreasing the initial off-rate (reported as 0.00108 vs 0.00221 $s^{-1}$).

Surface plasmon resonance (SPR) measurements were performed on a BIAcore™ T100 SPR (Pharmacia Biotech AB, Uppsala) using HBS-EP+ (GE Healthcare) as a running buffer. CD80-mIgG (25 µg/mL in 10 mM sodium acetate, pH 4.0; Ancell, Inc) was directly immobilized onto a CM5 chip using standard amine coupling chemistry (Biacore Amine Coupling Kit, GE Healthcare), with final immobilization levels of 317, 973, and 1678 Ru (resonance units). CTLA4-containing constructs were injected for 150 seconds, at a flow rate of 10 µl/min, in a series of concentrations from 5 nM to 1 µM. Dissociation was monitored for 600 seconds, and the surface was regenerated by injecting 50 mM sodium citrate, 500 mM sodium chloride, pH 4.0, for 60 seconds. Binding interactions with the surface were stable through at least 75 regeneration cycles. Data were analyzed using BiaEvaluation for the T100 software (version 2.0.1, GE Healthcare).

Binding kinetics of the CTLA4 constructs to immobilized CD80 could not be fit to a 1:1 Langmuir binding model, but could be fit with high accuracy to a bivalent analyte binding model. Increasing the association phase by increasing the length of injection did not alter the calculated kinetic parameters. Equilibrium dissociation constants ($K_D$) could be calculated with high accuracy for each construct by fitting the observed response at saturation to a steady-state equilibrium model. The results for all CD80 binding molecules are summarized in Table 5 below.

TABLE 5

| Immobilized Protein | Analyte | First Site $k_a$ ($M^{-1}s^{-1}$) | First Site $k_d$ ($s^{-1}$) | Second Site $k_a$ ($s^{-1}$) | Second Site $k_d$ ($s^{-1}$) | $K_D$ (nM) |
|---|---|---|---|---|---|---|
| CD80 | abatacept | $5.5 \pm 0.02 \times 10^5$ | 0.006 | 0.00019 | $9.4 \pm 0.08 \times 10^{-4}$ | 130 ± 10 |
| CD80 | SEQ ID NO: 9 | $1.9 \pm 0.01 \times 10^5$ | 0.008 | $0.0045 \pm 0.0001$ | $0.015 \pm 0.0003$ | 233 ± 27 |
| CD80 | SEQ ID NO: 13 | $0.36 \pm 0.002 \times 10^5$ | $7.4 \pm 0.047 \times 10^{-4}$ | 0.0057 | 0.064 | 176 ± 29 |
| CD80 | SEQ ID NO: 171 | $9.77 \pm 5.83 \times 10^5$ | 0.0145 | 0.0190 | 0.0434 | 37.5 ± 9.5 |
| CD80 | SEQ ID NO: 173 | $12.1 \pm 6.81 \times 10^5$ | 0.0124 | 0.0207 | 0.0431 | 28.0 ± 6.5 |
| CD80 | SEQ ID NO: 217 | $1.55 \pm 0.203 \times 10^5$ | 0.00373 | 0.00102 | 0.00332 | 13.3 ± 6.2 |
| CD80 | SEQ ID NO: 219 | $0.908 \pm 0.307 \times 10^5$ | 0.00235 | 0.00406 | 0.00706 | 19.1 ± 5.3 |

Equilibrium affinities for the Xceptors were determined to resemble that for abatacept and the reported affinity for CTLA4-Fc (200 nM; Greene et al. 1996, Ibid). Binding kinetics for the CTLA4::PDL1 xceptor were different from those for abatacept or the CTLA4::IL10 xceptor, although the on/off rate compensation gives a similar affinity. This may be due to the fact that PD-L1 binds CD80 with a weaker affinity than CTLA4 ($K_D$ of 2.5 µM). Similar to previous studies, CTLA4 variants containing the L104E A29Y mutation (SEQ ID NOS:217 and 219) had a higher affinity for CD80, with a roughly two fold improvement in initial off rate (0.00373 s' for SEQ ID NO:217 as compared to 0.006 $s^{-1}$ for abatacept).

Example 10

Xceptor Binding to CD86 by BIAcore™

CD86 binding activity was examined for abatacept, a CTLA4-Fc fusion containing the L104E A29Y mutations, analogous to belatacept (SEQ ID NO:217), an xceptor containing a CTLA4 ectodomain and an IL10 domain (SEQ ID NO: 9), an xceptor containing a CTLA4 ectodomain with the L104E A29Y mutations and an IL10 domain (SEQ ID NO:219), and different constructs (SMIP, PIMS, and xceptor) containing antibody variable domains from the 3D1 and FUN1 anti-CD86 antibodies, substantially as described herein. Binding of CD86 by CTLA4 is of low affinity ($K_d$=~2.2 µM), and is characterized by a fast on rate ($2-13 \times 10^5$ $M^{-1}$ $s^{-1}$) and a moderate off rate (0.42 $s^{-1}$). The L104E A29Y mutations on CTLA4-Fc have been reported to increase the affinity for CD86 four-fold over the wild type CTLA4-Fc (Larsen et al (2005) Am. J. Transplant. 5:443-453), primarily by decreasing the initial off-rate (reported as 0.00206 vs 0.00816 $s^{-1}$). Apparently, no kinetic or equilibrium affinity data has been previously published for the 3D1 or FUN1 antibodies, so their relative affinities were determined.

Lower-Affinity CD86 Binding Domains Based on the CTLA4 Ectodomain.

SPR measurements were performed on a BIAcore™ T100 SPR (Pharmacia Biotech AB, Uppsala) using HBS-EP+ (GE Healthcare) as a running buffer. CD86-mIgG (25 µg/mL in 10 mM sodium acetate, pH 4.0, Ancell, Inc) was directly immobilized onto a CM5 chip using standard amine coupling chemistry (Biacore Amine Coupling Kit, GE Healthcare), with final immobilization levels of 37, 373, and 903 Ru. CTLA4-containing constructs were injected for 150 seconds, at a flow rate of 10 µl/min, in a series of concentrations from 4 nM to 10 µM. Dissociation was monitored for 600 seconds, and the surface was either regenerated by injecting 50 mM sodium citrate, 500 mM sodium chloride, pH 5.0, for 60 seconds (wild type CTLA4) or 10 mM glycine, pH 1.7 (L104E A29Y CTLA4). Binding interactions with the surface, and immobilization levels, were stable through at least 100 regeneration cycles. Data were analyzed using BiaEvaluation for the T100 software (version 2.0.1, GE Healthcare). Owing to the low affinity of CTLA4 to CD86, and the very fast on and off rates (literature values are $0.2-1.3 \times 10^6$ $M^{-1}$ $s^{-1}$ for $k_a$ and $0.42$ $s^{-1}$ for $k_d$, at the limit of detection for the BIAcore™ T100 instrument) binding kinetics of abatacept to immobilized CD86 could not be determined. Binding kinetics of the constructs with the L104E A29Y CTLA4 domain (SEQ ID NO:217; SEQ ID NO:219) to immobilized CD86 could be determined with reasonable accuracy by fitting the observed response to the bivalent analyte model, however. Equilibrium dissociation constants ($K_D$) could be calculated with high accuracy for all constructs by fitting the observed response at saturation to a steady-state equilibrium model. The results are shown in Table 6, below.

Higher-Affinity CD86 Binding Domains Based on the 3D1 and FUN1 Antibody Variable Domains.

SPR measurements were performed as listed above, with the following exceptions: HBS-P+ (GE Healthcare) was used as a running buffer; dissociation was monitored for 1200 seconds; and the surface was regenerated by injecting 10 mM glycine, pH 1.7, for 60 seconds. Binding kinetics to immobilized CD86 could be determined in all cases. However, equilibrium dissociation constants ($K_D$) could be calculated with high accuracy for each construct by fitting the observed response at saturation to a steady-state equilibrium model. The results are shown in Table 6 below.

containing the L104E A29Y mutation (SEQ ID NO:217; SEQ ID NO:219) had a four-to-five fold higher affinity for CD86 (670-772 nM). Constructs containing 3D1 murine single-chain antibody fragments (scFvs) on the N-terminus (3D1 SMIP, SEQ ID NO: 317; 3D1::IL10, SEQ ID NO:189) had higher affinities (11.7, 26.5 nM) than the corresponding constructs with the 3D1 scFv on the C-terminus (3D1 PIMS, SEQ ID NO: 319; IL10::3D1, SEQ ID NO:185); examining the binding kinetics, this appeared to arise from both a higher initial on-rate and a lower initial-off rate, although in all cases, the affinity was at least 100-fold higher for CD86 than abatacept. For the FUN1 antibody, the parent murine monoclonal antibody was examined along with SMIP proteins containing two humanized single-chain FUN1 antibody fragments (SEQ ID NOS:225 and 227); the latter of the two (SEQ ID NO:227) showed similar binding kinetics and overall affinity to CD86 as the parent FUN1 mAb (26.9, 36 nM, respectively), which, again, was significantly higher than that of abatacept. Xceptor or PIMS molecules containing humanized FUN1 antibody fragments at the carboxy-terminus (IL10::FUN1-21, SEQ ID NO: 254; (IL10 I87A::FUN1-21)-75, SEQ ID NO:258; (monoIL10-A2 hinge::FUN1-21)-75, (SEQ ID NO:276); FUN1-21 PIMS, SEQ ID NO:402) had lower affinities than the xceptor containing the parent antibody sequence at the amino-terminus (FUN1::IL10, SEQ ID NO:187)) or the same FUN1-21 binding sequence on a SMIP protein (SEQ ID NO:227).

Example 11

Xceptor Binding to Murine CD86 by BIAcore™

Murine CD86 binding activity was examined for abatacept, a CTLA4-Fc fusion containing the L104E A29Y mutations, analogous to belatacept (SEQ ID NO:217), two xceptors containing different BD2 linkers but the same CTLA4 and IL10 domains (SEQ ID NOS:171 and 173), an xceptor containing a CTLA4 ectodomain with the L104E A29Y mutations and an IL10 domain (SEQ ID NO:219), a murine CTLA4 fusion to human Fc domain (SEQ ID NO:404), and different constructs containing antibody variable domains from the rat GL1 anti-murine CD86 antibody, including two xceptors containing a GL1 antibody fragment and human IL10 domain (GL1::IL10, SEQ ID NO:252; and IL10::GL1, SEQ ID NO:256), substantially as described

TABLE 6

| Immobilized Protein | Analyte | First Site $k_a$ ($M^{-1}s^{-1}$) | First Site $k_d$ ($s^{-1}$) | Second Site $k_a$ ($s^{-1}$) | Second Site $k_d$ ($s^{-1}$) | $K_D$ (nM) |
|---|---|---|---|---|---|---|
| CD86 | abatacept | — | — | — | — | 3200 ± 1600 |
| CD86 | SEQ ID NO: 217 | $0.847 \times 10^5$ | 0.01016 | 0.0298 | 0.0344 | 772 ± 300 |
| CD86 | SEQ ID NO: 219 | $0.451 \times 10^5$ | 0.00910 ± 0.0001 | 0.011 | 0.0221 | 670 ± 180 |
| CD86 | 3D1 SMIP | $3.23 \times 10^5$ | $4.40 \pm 0.05 \times 10^{-5}$ | 0.0055 | 0.0276 | 11.7 ± 1.2 |
| CD86 | SEQ ID NO: 189 | $9.74 \pm 0.066 \times 10^5$ | $7.06 \pm 0.04 \times 10^{-5}$ | 0.0094 | 0.0462 | 26.5 ± 2.9 |
| CD86 | SEQ ID NO: 328 | $1.12 \times 10^5$ | $2.37 \pm 0.13 \times 10^{-5}$ | 0.00077 | 0.00377 | 28.0 ± 1.9 |
| CD86 | SEQ ID NO: 185 | $6.17 \pm 0.12 \times 10^5$ | $8.30 \pm 0.12 \times 10^{-5}$ | 0.0124 | 0.102 | 35.7 ± 2.5 |
| CD86 | FUN1 mAb | $1.29 \pm 0.69 \times 10^5$ | $2.28 \pm 0 \times 10^{-5}$ | 0.00278 | 0.0154 | 36.0 ± 5.5 |
| CD86 | SEQ ID NO: 225 | $0.139 \pm 0.556 \times 10^5$ | $35.0 \times 10^{-5}$ | $7.5 \times 10^{-5}$ | $1.25 \pm 0.25 \times 10^{-6}$ | 119 ± 40 |
| CD86 | SEQ ID NO: 227 | $1.86 \pm 0.951 \times 10^5$ | $13.9 \times 10^{-5}$ | 0.00578 | 0.0127 | 26.9 ± 5.4 |
| CD86 | SEQ ID NO: 402 | $0.5 \times 10^5$ | $9.1 \times 10^{-5}$ | 0.00113 | 0.00837 | 70.9 ± 5.9 |
| CD86 | muIL 10-Ig | $0.941 \times 10^5$ | $18 \times 10^{-5}$ | 0.0203 | 0.0722 | 50.6 ± 7 |
| CD86 | SEQ ID NO: 254 | $1.58 \times 10^5$ | $12.8 \times 10^{-5}$ | 0.0064 | 0.0387 | 98.6 ± 10 |
| CD86 | SEQ ID NO: 258 | $0.407 \times 10^5$ | $43.3 \pm 1.2 \times 10^{-5}$ | 0.0198 | 0.0579 | 88.5 ± 19 |
| CD86 | SEQ ID NO: 276 | $0.126 \times 10^5$ | $34.4 \times 10^{-5}$ | 0.011 | 0.0111 | 178 ± 18 |

Equilibrium affinities for abatacept (3.2 µM) resembled the reported affinity for CTLA4-Fc (2.2 µM; Greene et al. 1996, Ibid). Similar to previous studies, CTLA4 variants below. Human CTLA4 is known to be cross-reactive to murine CD86, but, to the best of our knowledge, no kinetic or affinity measurements have been previously described.

Similarly, the rat GL1 antibody has been described as being specific for murine CD86, but no kinetic or affinity measurements have been reported.

SPR measurements were performed on a BIAcore™ T100 SPR (Pharmacia Biotech AB, Uppsala) using HBS-EP+ (GE Healthcare) as a running buffer. Murine CD86-mIgG (25 µg/mL in 10 mM sodium acetate, pH 4.0, R&D Systems, Inc) was directly immobilized onto a CM5 chip using standard amine coupling chemistry (Biacore Amine Coupling Kit, GE Healthcare), with final immobilization levels of 150, 493, and 746 Ru. CTLA4-containing constructs were injected for 150 seconds, at a flow rate of 10 µl/min, in a series of concentrations from 4 nM to 8 µM. Dissociation was monitored for 600 seconds (CTLA4 constructs) or 1200 seconds (GL1 constructs), and the surface was regenerated by injecting 10 mM glycine, pH 1.7, for 60 seconds. Binding interactions with the surface, and immobilization levels, were stable through at least 100 regeneration cycles. Data were analyzed using BiaEvaluation for the T100 software (version 2.0.1, GE Healthcare). Binding kinetics to immobilized murine CD86 could be determined for all constructs, and fit with high accuracy to a bivalent analyte model (Table 7). Equilibrium dissociation constants ($K_D$) could also be calculated with high accuracy for each construct by fitting the observed response at saturation to a steady-state equilibrium model. For the CTLA4 variants (SEQ ID NOS:171, 173, 217, 219, and 404), simultaneous equilibrium fits across all three flow cells at three different immobilization densities gave more accurate results than fitting any one flow cell (a so-called 'multiple Rmax' fit), and so those affinities are listed. The results are shown in Table 7, below.

CD86 compared to the parent antibody or SMIP, although this appeared to arise from either a reduced initial on-rate or off-rate in each case.

Example 12

Xceptor Binding to PD1 by BIAcore™

PD1 binding activity was examined for PDL1-Fc (SEQ ID NO:268) and PDL2-Fc (SEQ ID NO:270), as well as xceptors containing a CTLA4 ectodomain and either PDL1 (SEQ ID NO:13) or PDL2 (SEQ ID NO:336) domains, substantially as follows. Binding of PD1 by PDL2 has been generally reported to be higher affinity than the binding of PD1 by PDL1; a prior kinetic analysis (Youngnak et al, (2003) Biochem. Biophys. Res. Comm. 307, 672) suggested moderate affinities (112 nM for PDL1, 37 nM for PDL2), whereas a equilibrium analysis done in an alternate format (Butte et al, (2007) Immunity 27, 111) suggested weaker affinities (770 nM for PDL1, 590 nM for PDL2).

SPR measurements were performed on a BIAcore™ T100 SPR (Pharmacia Biotech AB, Uppsala) using HBS-P+ (GE Healthcare) as a running buffer. A construct with the PD1 ectodomain fused to a C-terminal AviTag™ (SEQ ID NO:406) was initially biotinylated using the BirA enzyme (Avidity, Inc., Aurora, Colo.) in 10 mM Tris, pH 8.0, and buffer exchanged into PBS. Neutravidin (100 µg/mL in 10 mM sodium acetate, pH 4.0, Thermo Scientific, Rockford, Ill.) was directly immobilized onto a CM5 chip using standard amine coupling chemistry (Biacore Amine Coupling Kit, GE Healthcare), with final immobilization levels

TABLE 7

| Immobilized Protein | Analyte | First Site $k_a$ (M$^{-1}$s$^{-1}$) | First Site $k_d$ (s$^{-1}$) | Second Site $k_a$ (s$^{-1}$) | Second Site $k_d$ (s$^{-1}$) | $K_D$ (nM) |
|---|---|---|---|---|---|---|
| muCD86 | SEQ ID NO: 171 | 0.104 × 10$^5$ | 0.0241 | 0.0398 | 0.0627 | 1540 ± 210 |
| muCD86 | SEQ ID NO: 173 | 0.132 × 10$^5$ | 0.0228 | 0.0405 | 0.0625 | 1810 ± 230 |
| muCD86 | SEQ ID NO: 217 | 0.278 × 10$^5$ | 0.0787 | 0.0728 ± 0.0023 | 0.168 | 920 ± 88 |
| muCD86 | SEQ ID NO: 219 | 0.321 × 10$^5$ | 0.0418 | 0.00026 | 0.00193 | 870 ± 160 |
| muCD86 | muCTLA4-Ig | 0.278 × 10$^5$ | 0.0386 | 0.000659 | 0.00311 | 2250 ± 190 |
| muCD86 | GL1 mAb | 0.789 ± 0.346 × 10$^5$ | 10.6 × 10$^{-5}$ | 0.00879 | 0.00635 | 37.7 ± 4.4 |
| muCD86 | GL1 SMIP | 1.18 ± 0.427 × 10$^5$ | 6.2 × 10$^{-5}$ | 0.00964 ± 0.00031 | 0.0185 | 26.2 ± 5.4 |
| muCD86 | GL1 PIMS | 1.77 × 10$^5$ | 1.25 × 10$^{-4}$ | 0.0431 | 0.0977 | 78.3 ± 20 |
| muCD86 | SEQ ID NO: 252 | 2.19 × 10$^5$ | 1.9 × 10$^{-4}$ | 0.00943 | 0.0182 | 86.4 ± 8.3 |
| muCD86 | SEQ ID NO: 256 | 6.73 × 10$^4$ | 4.4 × 10$^{-5}$ | 0.0271 | 0.088 | 95.1 ± 13 |

Xceptors containing human CTLA4 and human IL10 domains (SEQ ID NOS:171 and 173) had slightly higher affinities to murine CD86 (1.54, 1.81 µM) than the reported affinity for human CTLA4-Fc for human CD86 (2.2 µM; Greene et al. 1996). Human CTLA4 variants containing the L104E A29Y mutation (SEQ ID NOS:217 and 219) had only a two fold higher affinity for murine CD86 (870-920 nM); this seems to arise from a combination of a beneficial higher initial on-rate for murine CD86 and a detrimental higher initial off-rate. Murine CTLA4 seems to have an analogous, or slightly lower overall affinity for murine CD86 than human CTLA4. For the GL1 antibody, the parent rat monoclonal antibody was examined along with a SMIP containing a single-chain GL1 antibody fragment (GL1 SMIP, SEQ ID NO:239); both showed similar binding kinetics and overall affinity to murine CD86 (37.7, 26.2 nM, respectively), which, was significantly higher (~50 fold) than that of human or murine CTLA4-containing constructs. Xceptors containing IL-10 and the GL1 antibody fragment (SEQ ID NOS:252 and 256) showed a 3-fold lower affinity to murine of 191, 771, and 1522 Ru, and used to capture biotinylated PD1 at levels of 171, 597, and 1244 Ru, respectively. PDL1/2-containing constructs were injected for 120 seconds, at a flow rate of 30 µl/min, in a series of concentrations from 6 nM to 2 µM. Dissociation was monitored for 1200 seconds, and the surface was regenerated by injecting 50 mM NaOH, 1M NaCl for 30 seconds. Binding interactions with the surface, and immobilization levels, were stable through at least 50 regeneration cycles.

Data were analyzed using BiaEvaluation for the T100 software (version 2.0.1, GE Healthcare). Binding kinetics to immobilized PD1 could be determined for all constructs, and fit either with high accuracy to a bivalent analyte model (SEQ ID NOS:268 and 270) or a 1:1 binding model (SEQ ID NOS:13 and 336) (Table 8). Equilibrium dissociation constants ($K_D$) could also be calculated with high accuracy for each construct by fitting the observed response at saturation to a steady-state equilibrium model. The results are shown in Table 8, below.

TABLE 8

| Immobilized Protein | Analyte | First Site $k_a$ (M$^{-1}$s$^{-1}$) | First Site $k_d$ (s$^{-1}$) | Second Site $k_a$ (s$^{-1}$) | Second Site $k_d$ (s$^{-1}$) | $K_D$ (nM) |
|---|---|---|---|---|---|---|
| PD1 | SEQ ID NO: 13 | 0.699 × 10$^5$ | 0.165 | n/a | n/a | 2360** |
| PD1 | SEQ ID NO: 336 | 1.16 × 10$^5$ | 0.0395 | n/a | n/a | 340** |
| PD1 | SEQ ID NO: 268 | 0.96 ± 0.54 × 10$^5$ | 0.0544 | 3.18 × 10$^{-6}$ | 0.000191 | 246 ± 27 |
| PD1 | PDL1-Fc* | 1.07 × 10$^5$ | 0.010 | n/a | n/a | 112** |
| PD1 | SEQ ID NO: 270 | 1.65 × 10$^5$ | 0.00724 | 0.0352 | 0.395 | 42 ± 4.4 |
| PD1 | PDL2-FC* | 1.22 × 10$^5$ | 0.0032 | n/a | n/a | 26** |

*Literature value (Youngnak et al, (2003) Biochem. Biophys. Res. Comm. 307, 672)
**Kinetic $K_D$ calculated from first site $k_a$ and $k_d$ PDL1-Fc (SEQ ID NO:268) and PDL2-Fc (SEQ ID NO:270) showed similar binding kinetics and overall affinities to those reported in literature. Xceptors containing CTLA4 with PDL1 or PDL2 domains fused at the carboxy-terminus (SEQ ID NOS:13 and 336) had noticeably weaker (~10 fold) affinities to PD1 (2.36, 0.34 µM) than the amino-terminal PDL1/PDL2 fusions (246, 42 nM); this primarily arises from a noticeable increase in the initial off-rate (0.165, 0.0395 vs 0.0544, 0.00724), indicating the PDL1/2:PD1 complex may be destabilized when the binding domain is at the BD2 (carboxy-terminal) position.

Example 13

Xceptor Fusion Proteins Block Human T Cell Responses

This example demonstrates that xceptor fusion proteins of this disclosure can block a human T cell response. A mixed lymphocyte reaction (MLR) was used to test blocking by xceptor fusion proteins. In brief, human peripheral blood mononuclear cells (PBMC) from two donors were isolated using standard methods and kept separate. Based on previous studies, PBMC from one donor were designated as the "Responder" population and PBMC from the second donor were designated as the "Stimulator" population. Both donor PBMC were labeled with CFSE using standard methods. To prevent cell division, Stimulator PBMC were treated with mitomycin-C (MMC). MMC (Sigma #M4287-2 mg) was reconstituted in sterile distilled water (Gibco #15230) at a concentration of 0.5 mg/ml. Stimulator PBMC were suspended at a concentration of 1×10$^6$/ml in complete culture media (CM), (RPMI-1640 containing 10% human B serum, 100 U/ml penicillin, 100 ug/ml streptomycin, 2 mM L-glutamine, NEAA, Na-pyruvate, CM 0.2 um filtered) and MMC was added to a final concentration of 25 µg/ml. The Stimulator PBMC/MMC mixture was then incubated at 37° C., 5% CO$_2$, for 30 minutes after which cells were washed thrice with CM. Responder and Stimulator cells were suspended at a concentration of 4×10$^6$/ml in CM and 0.05 ml of each cell population was added per well of a 96 well-flat bottom tissue culture plate for a final 2×10$^6$ cells/well/donor. All treatments at the designated concentrations shown in figures were added to the plate at the same time as the cells (note concentrations shown for antibodies and fusion proteins are at molar equivalents). MLR conditions (96 well plate PBMC treatment set-up) were then incubated at 37° C., 5% CO$_2$, for the duration of the experiment. MLR experiments were harvested 7-8 days at which cells were stained with fluorescently tagged antibodies against CD5 (e-Bioscience) and CD25 (BD Biosciences) and run on a flow cytometer (LSR II, Becton Dickenson). Data was analyzed using FlowJo flow cytometry software (TreeStar). The gating strategy was as follows: cells that fell within a FSC:SSC lymphocyte gate were analyzed for CD5 expression, cells that then subsequently fell within the CD5+ gate were analyzed for CFSE dilution and CD25 up-regulation. Cells that were CD5+, CFSE$^{low}$ and CD25$^{high}$ were considered activated T cells.

FIGS. 16, 17, 21, and 22 show that many different kinds of xceptor fusion proteins containing a CD86 antagonist in combination with a heterologous binding domain are capable of blocking a T cell response to Responder/Stimulator MLR conditions.

Example 14

CD86 Antagonist Xceptors Block a Mouse T Cell Response

Mice splenocytes from two different mouse strains, C57BL/6 (or B6D2F1) and BALB/c, were isolated utilizing the scalpel/nylon mesh and RBC lyse method. Based on previous studies, splenocytes from mouse strain C57Bl/6 (or B6D2F1) were designated as the "Responder" population and splenocytes from mouse strain BALB/c were designated as the "Stimulator" population. Both mouse strain splenocytes were labeled with CFSE as previously described. To prevent cell division, Stimulator splenocytes were treated with mitomycin-C (MMC). MMC (Sigma #M4287-2 mg) was reconstituted in sterile distilled water (Gibco #15230) at a concentration of 0.5 mg/ml. Stimulator splenocytes were suspended at a concentration of 5×10$^7$/ml in complete culture media (CM), (RPMI-1640 containing 10% FBS, 100 U/ml penicillin, 100 µg/ml streptomycin, 2 mM L-glutamine, NEAA, Na-pyruvate, and 0.05 mM 2-mercaptoethanol) and MMC was added to a final concentration of 50 µg/ml. The Stimulator splenocyte/MMC mixture was then incubated at 37° C., 5% CO$_2$, for 20 minutes after which cells were washed thrice with CM. Responder and Stimulator cells were suspended at a concentration of 8×10$^5$/ml in CM and 0.05 ml of each cell population was added per well of a 96 well-flat bottom tissue culture plate for a final 4×10$^5$ cells/well/strain. All treatments at the designated concentrations shown in FIGS. 18-20 were added to the plate at the same time as the cells (note concentrations shown for antibodies and fusion proteins are at molar equivalents). MLR conditions (96 well plate with splenocyte/treatment set-up) were then incubated at 37° C., 5% CO$_2$, for the duration of the experiment. MLR experiments were harvested 4-5 days at which cells were stained with fluorescently tagged antibodies against CD5 (BD Biosciences) and CD25 (BD Biosciences) and run on a flow cytometer (LSR II, Becton Dickenson). Data was analyzed using FlowJo flow cytometry software (TreeStar). The gating strategy was as follows: cells that fell within a FSC:SSC lymphocyte gate were analyzed for CD5 expression, cells that then subsequently fell within the CD5+ gate were analyzed for CFSE dilution and CD25 up-regulation. Cells that were CD5+, CFSE$^{low}$ and CD25$^{high}$ were considered activated T cells.

Figure 18:
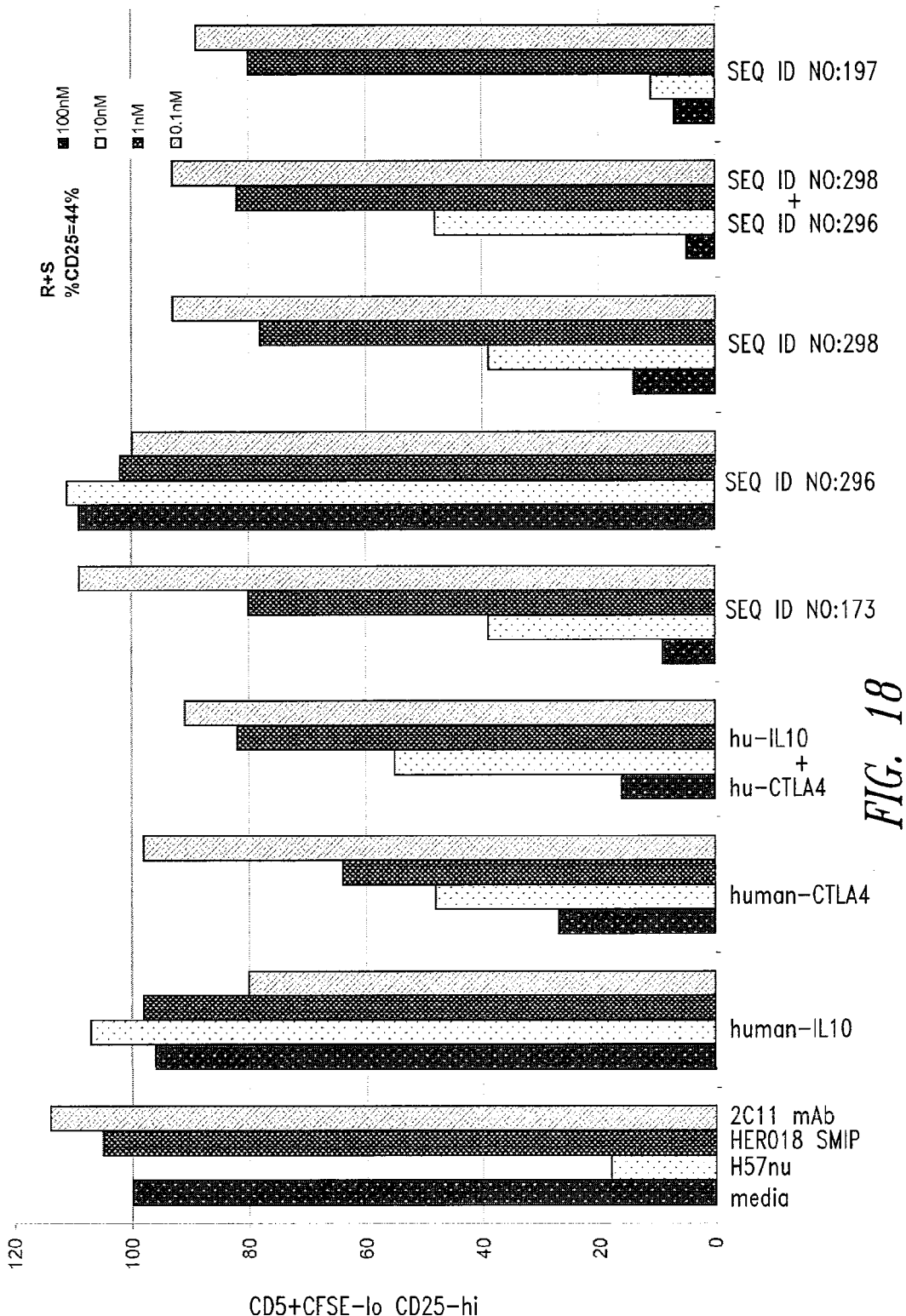
FIGS. 18 to 20 show that several xceptor proteins block a mouse T cell response in an MLR assay.
Figure 19:
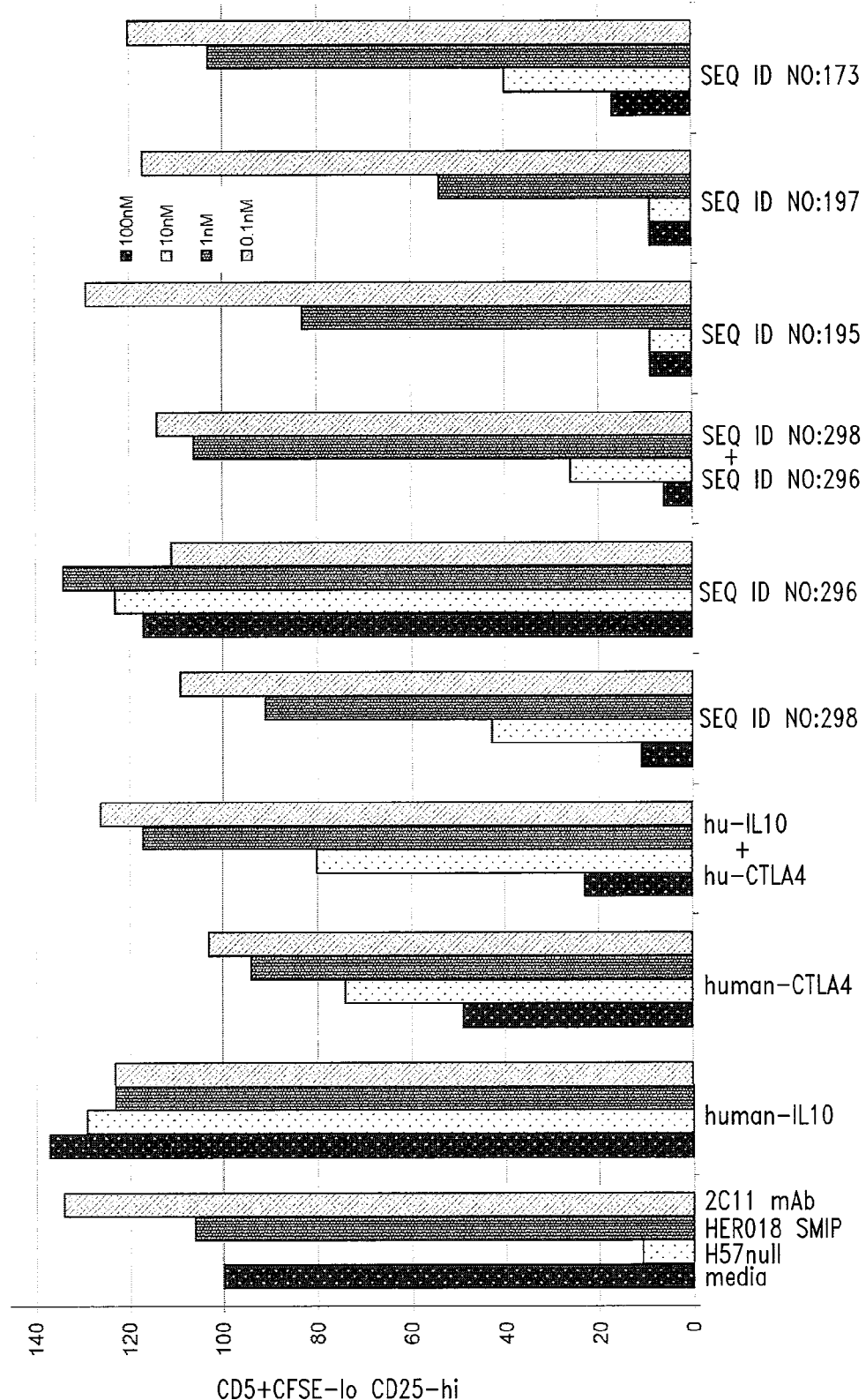
Figure 20:
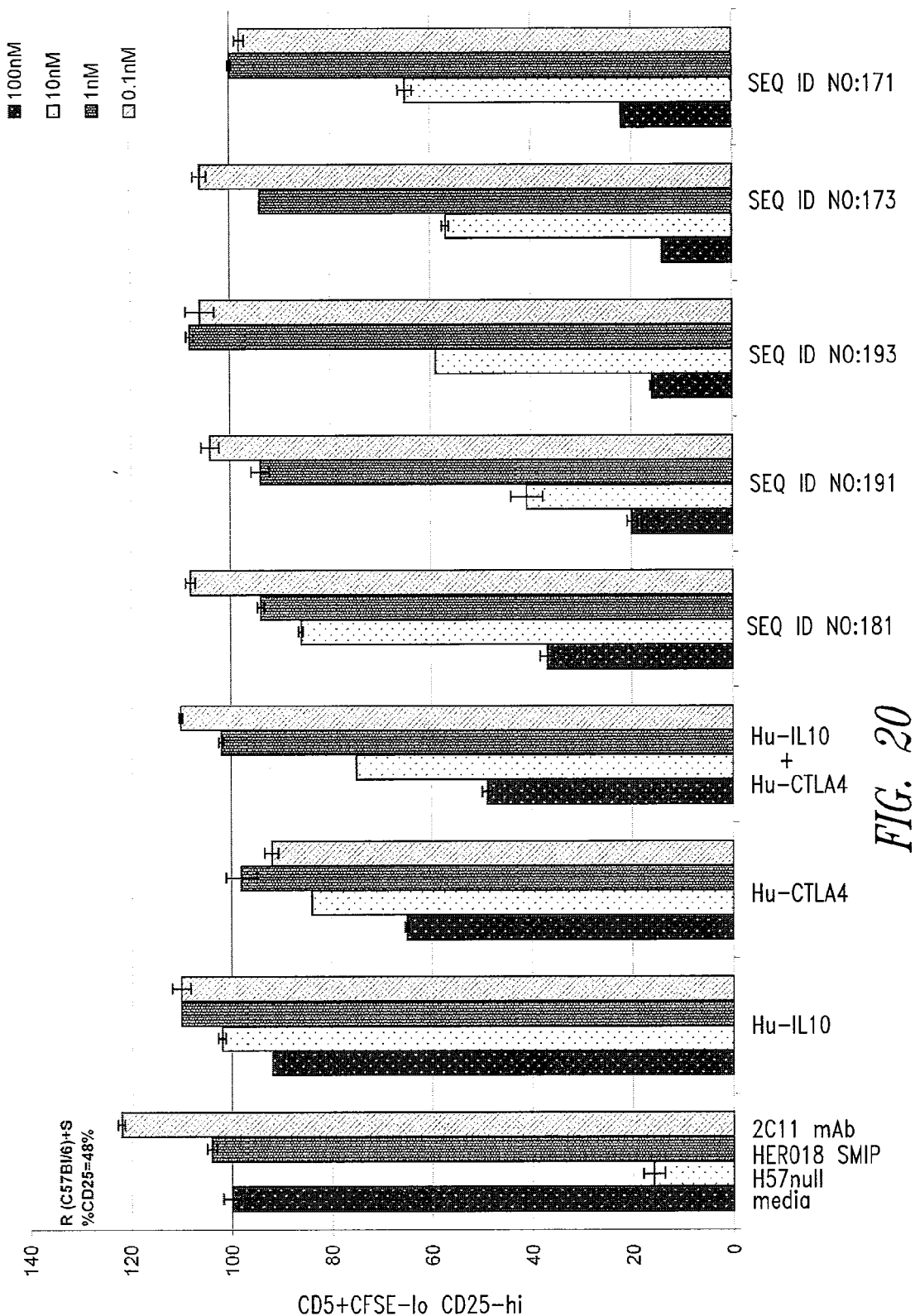
Figure 21:
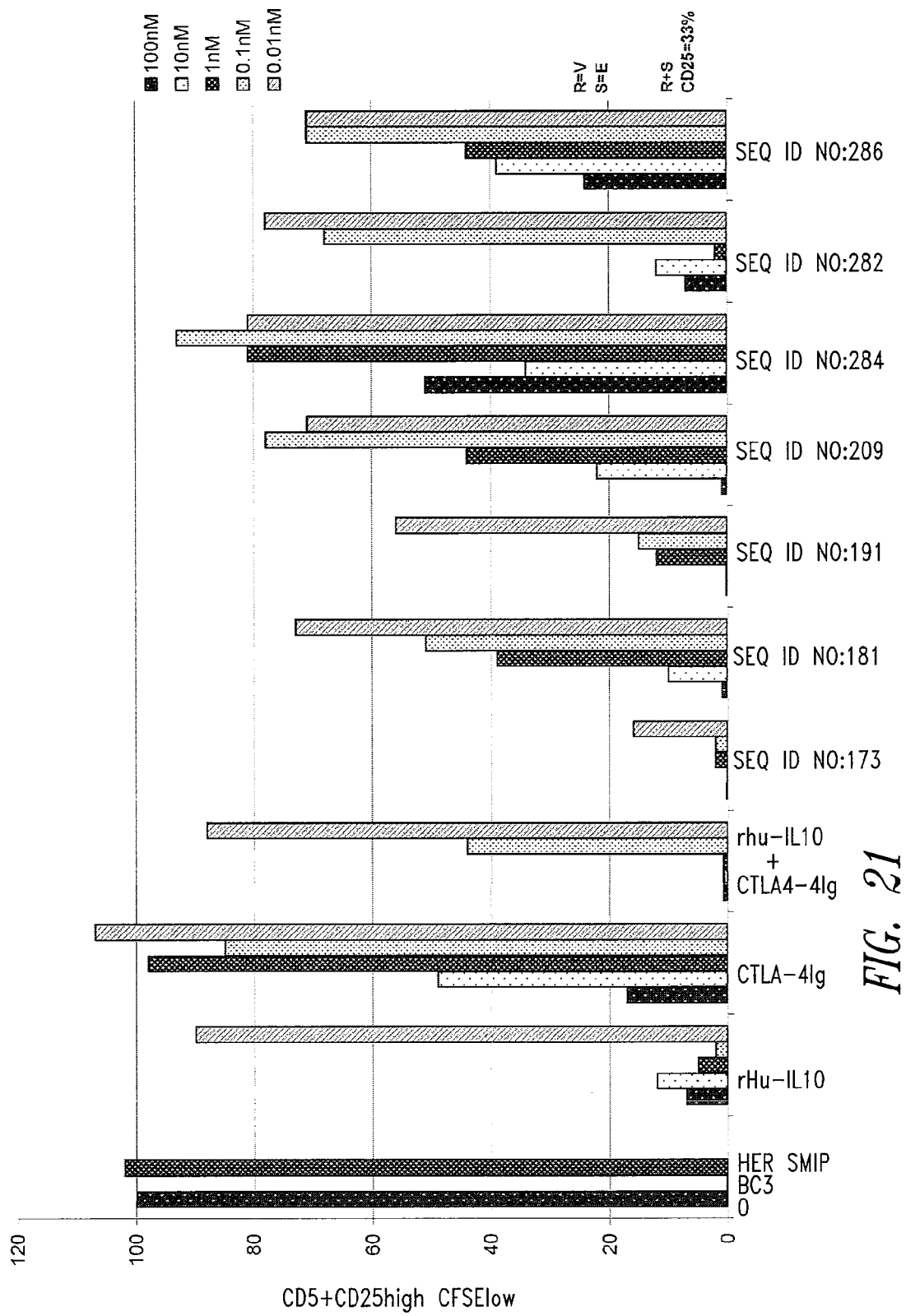
FIGS. 21 and 22 show that several xceptor proteins containing a variant IL10 (either IL10 with an I87 mutation or monoIL10) or a variant CTLA4 block a human T cell response in an MLR assay.
Figure 22:
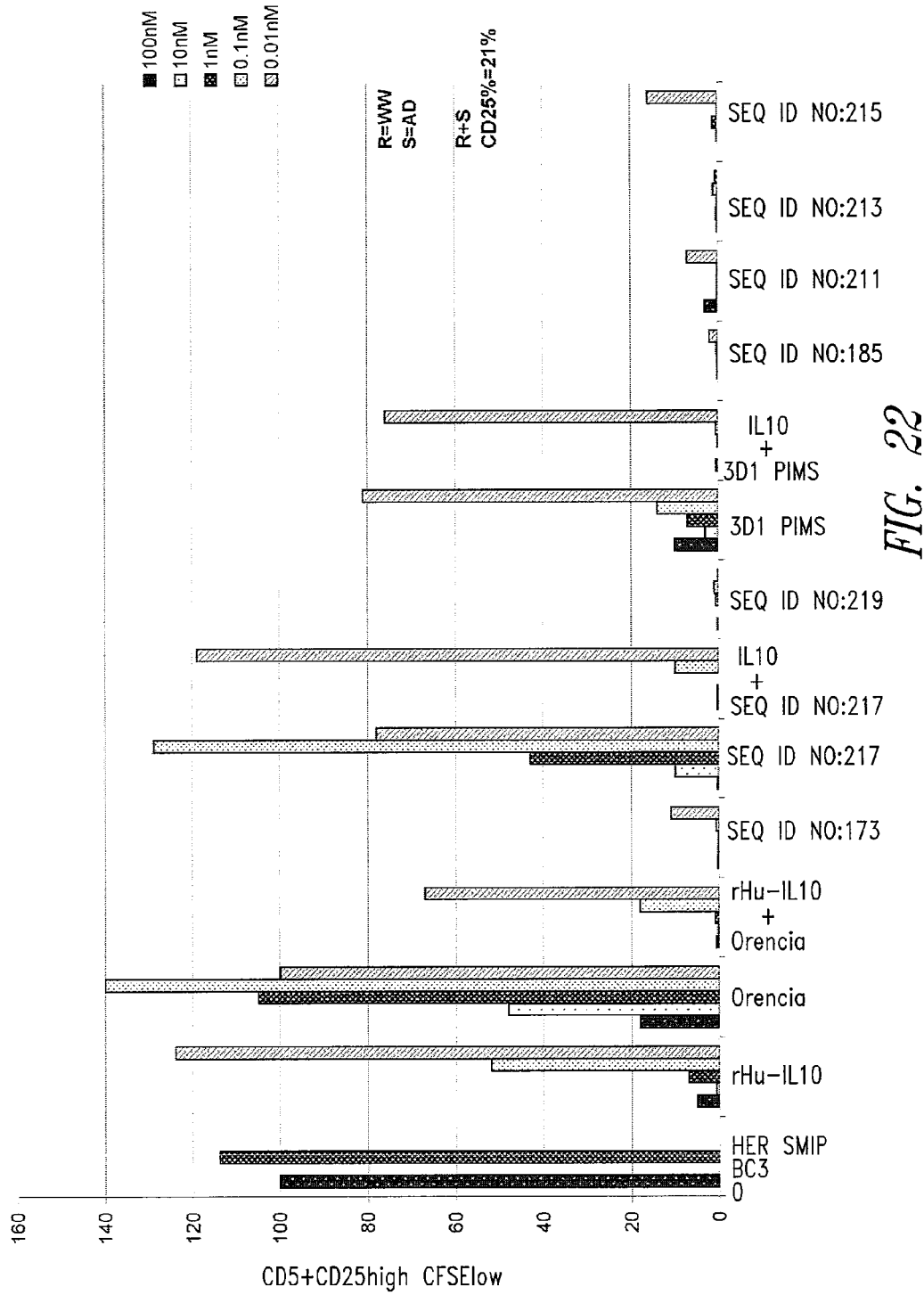
Figure 23:
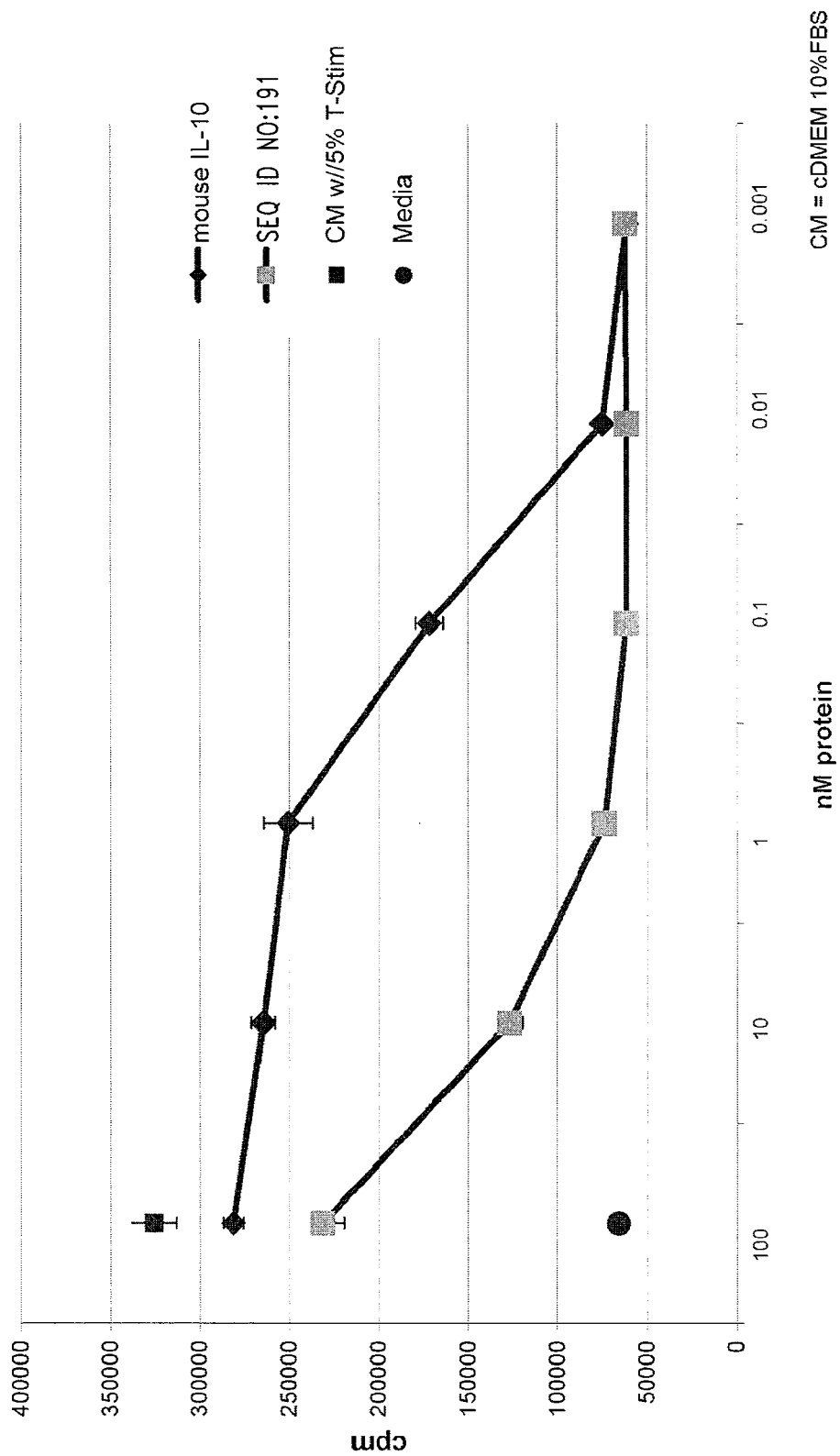
FIG. 23 shows that several xceptor proteins containing a variant IL10 (either MO with an I87 mutation or monoIL10) are less immunostimulatory than mouse IL10 in an MC/9 cell proliferation assay.
Figure 24:
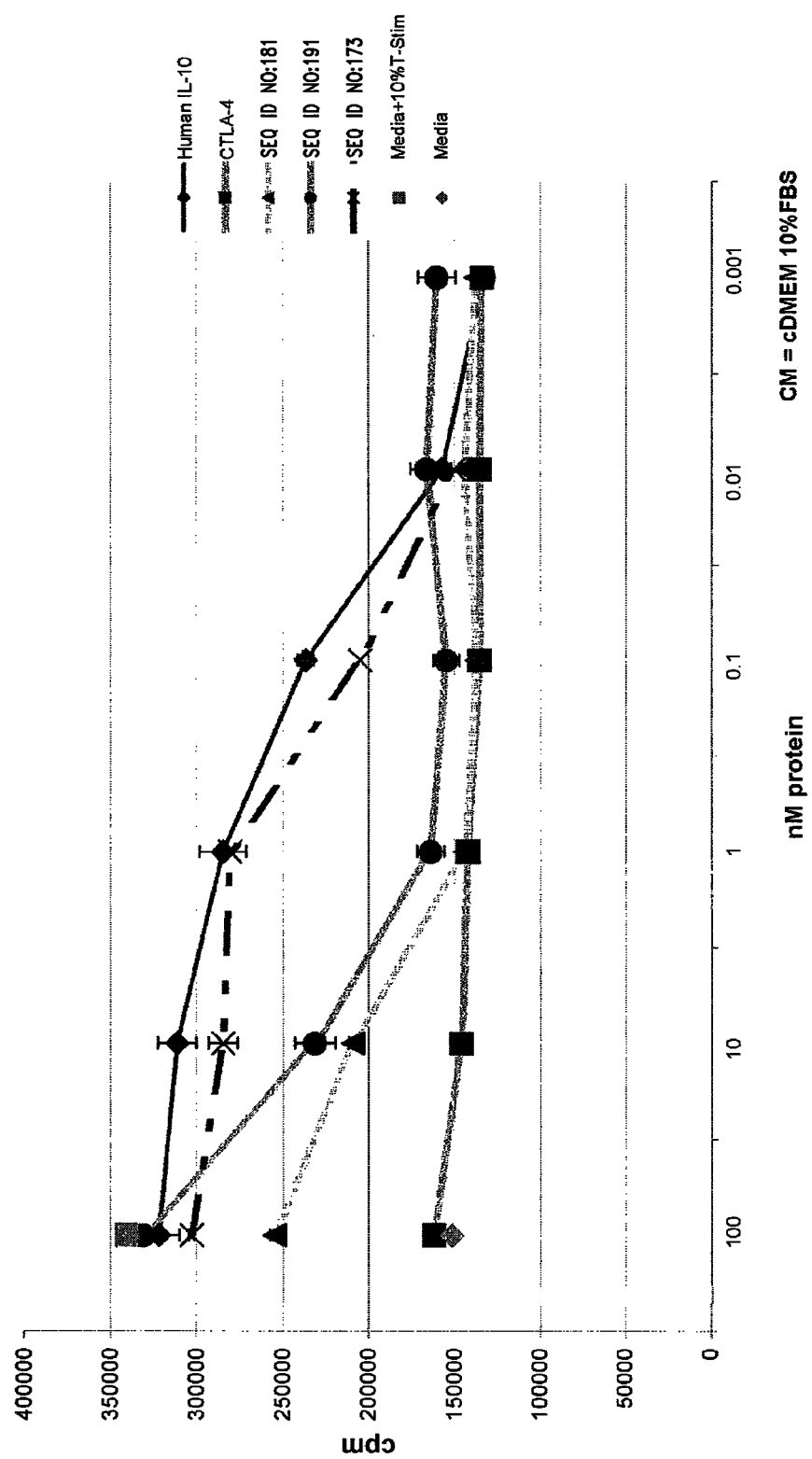
FIG. 24 shows that several xceptor proteins containing a variant IL10 (either IL10 with an I87 mutation or monoIL10) are less immunostimulatory than human IL10 in an MC/9 cell proliferation assay.

FIGS. 18-20 show that many different kinds of xceptor fusion proteins containing a CD86 antagonist in combination with a heterologous binding domain are capable of blocking a mouse T cell response to Responder (B6D2F1)/ Stimulator (BALB/c) MLR conditions.

Example 15

Immunostimulatory Activity of Xceptor Molecules Containing IL10

The immunostimulatory activity of IL10 in various xceptor fusion proteins was tested in an in vitro cell proliferation assay. In particular, the MC/9 mouse mast liver cell line was used as follows: MC/9 cell line (American Type Culture Collection™ #CRL-8306) were grown in DMEM or RPMI plus 10% FBS and 5% Rat T-STIM (BD #354115). MC/9 cells were washed and rested in media without Rat T-STIM overnight (incubated at 37° C., 5% CO2, in 96 well flat bottom plate at 1×105 cells/well, 100 μl/well). Various concentrations of IL10 protein and xceptor fusion proteins were incubated for 24 hours and proliferation was assessed by [3H] thymidine incorporation after 6 hours.

The I87 variant of IL10 is known to be less immunostimulatory compared to wild-type IL10 (Ding et al., *J. Exp. Med.* 191:213, 2000). IL10 normally forms a homodimer with the amino terminal domain of each monomer molecule binding to the carboxy terminal domain of the other monomer). The IL10 I87 variant (I87A and I87S), along with an IL10 molecule having a short linker (gggsgg; SEQ ID NO:379) that further separates the two subdomains of IL10 allowing these subdomains to form an intramolecular dimer, were examined in the xceptor format for immunostimulatory activity.

FIG. 23 shows that mouse IL10 is capable of enhancing MC/9 cell proliferation to greater extent than CTLA4::IL10-I87A (SEQ ID NO:191) xceptor, which contains a single mutation in amino acid 87 of IL10. FIG. 24 shows that both human IL10 and (CTLA4::IL10)-75 (SEQ ID NO:173) are capable of enhancing MC/9 cell proliferation more than either CTLA4::IL10-I87A (SEQ ID NO:191) or CTLA4::monoIL-10 (SEQ ID NO:181).

Example 16

Engineering Xceptor Molecules to Target Specific Cell Types

This Example describes the engineering of Xceptor fusion proteins to target specific cell types. This is achieved by engineering BD1 and BD2 affinities. Four Xceptor molecules were engineered with different affinity for CD86 and huIL10R1. Table 9 shows the different affinity ratios for these four molecules. By improving affinity for CD86 through the use of, for example, a CD86 binding domain (e.g., 3D1 or humanized FUN1) and an engineered IL10 molecule (I87A) with lower affinity for huIL10R1, then such an arrangement can be used to favor targeting to a specific cell type of interest, such as APC.

TABLE 9

| BD1 | BD2 | CD86 Affinity (nM) | IL10R1 Affinity (nM) | IL10R1/CD86 Affinity Ratio |
|---|---|---|---|---|
| CLTA4 | IL10 | 2000* | 0.1& | 0.00005 |
| CTLA4 | IL10 I87A | 2000* | 10# | 0.005 |

TABLE 9-continued

| BD1 | BD2 | CD86 Affinity (nM) | IL10R1 Affinity (nM) | IL10R1/CD86 Affinity Ratio |
|---|---|---|---|---|
| anti-CD86 | IL10 | 40* | 0.1& | 0.0025 |
| anti-CD86 | IL10 I87A | 40* | 10# | 0.25 |

*Approximate equilibrium affinity from in-house measurement of CTLA4, 3D1 and humanized FUN1 binding to CD86
&Approximate affinity based on Tan et al. (J. Biol. Chem. 268: 21053, 1993)
Approximate affinity based on Ding et al. (J. Exp. Med. 191: 213, 2000)

Example 17

Xceptor Activity in In Vivo Rheumatoid Arthritis Animal Models

Rheumatoid Arthritis

The therapeutic efficacy of any of the xceptor molecules disclosed herein is examined in at least one of two murine models of rheumatoid arthritis (RA), namely the collagen induced arthritis (CIA) and glucose-6-phosphate isomerase (G6PI) models. Each of these models has been shown to be useful for predicting efficacy of certain classes of therapeutic drugs in RA (see Holmdahl (2000) Arthritis Res. 2:169; Holmdahl (2006) Immunol. Lett. 103:86; Holmdahl (2007) Methods Mol. Med. 136:185; McDevitt, H. (2000) Arthritis Res. 2:85; Kamradt and Schubert (2005) Arthritis Res. Ther. 7:20).

(a) CIA Model

The CIA model is the best characterized mouse model of arthritis in terms of its pathogenesis and immunological basis. In addition, it is the most widely used model of RA and, although not perfect for predicting the ability of drugs to inhibit disease in patients, is considered by many to be the model of choice when investigating potential new therapeutics for RA (Jirholt et al. (2001) Arthritis Res. 3:87; Van den Berg, W. B. (2002) Curr. Rheumatol. Rep. 4:232; Rosloniec (2003) Collagen-Induced Arthritis. In Current Protocols in Immunology, eds. Coligan et al., John Wiley & Sons, Inc, Hoboken, N.J.).

In the CIA model, arthritis is induced by immunization of male DBA/1 mice with collagen II (CII) in Complete Freund's Adjuvant (CFA). Specifically, mice are injected intradermally/subcutaneously with CII in CFA on Day −21 and boosted with CII in Incomplete Freund's Adjuvant (IFA) on Day 0. Mice develop clinical signs of arthritis within days of the boost with CII/IFA. A subset of mice (0% to 10%) immunized with CII/CFA develop signs of arthritis on or around Day 0 without a boost and are excluded from the experiments. In some CIA experiments, the boost is omitted and mice are instead treated with Xceptor or control starting 21 days after immunization with CII/CFA (i.e. the day of first treatment is Day 0).

Mice are treated with Xceptor, vehicle (PBS), or negative or positive control in a preventative and/or therapeutic regimen. Preventative treatment starts on Day 0 and continues through the peak of disease in control (untreated) mice. Therapeutic treatment starts when the majority of mice show mild signs of arthritis. Enbrel®, which has been shown to have good efficacy in both the CIA and G6PI-induced models of arthritis, is used as a positive control. Data collected in every experiment includes clinical scores and cumulative incidence of arthritis. Clinical signs of arthritis in the CIA model are scored using a scale from 0 to 4 as shown in Table 10 below.

TABLE 10

| Score | Observations |
|---|---|
| 0 | No apparent swelling or redness |
| 1 | Swelling/redness in one to three digits |
| 2 | Redness and/or swelling in more than three digits, mild swelling extending into the paw, swollen or red ankle, or mild swelling/redness of forepaw |
| 3 | Swollen paw with mild to moderate redness |
| 4 | Extreme redness and swelling in entire paw |

(b) G6PI Model

In the G6PI model, arthritis is induced by immunization of DBA/1 mice with G6PI in adjuvant (Kamradt and Schubert (2005) Arthritis Res. Ther. 7:20; Schubert et al., (2004) J. Immunol. 172:4503; Bockermann, R. et al. (2005) Arthritis Res. Ther. 7:R1316; Iwanami et al., (2008) Arthritis Rheum. 58:754; Matsumoto et al., (2008) Arthritis Res. Ther. 10:R66). G6PI is an enzyme present in virtually all cells in the body and it is not known why immunization induces a joint specific disease. A number of agents, such as CTLA4-Ig, TNF antagonists (e.g. Enbrel®) and anti-IL6 receptor monoclonal antibody, have been shown to inhibit development of arthritis in the G6PI model.

Male DBA/1 mice are immunized with G6PI in Complete Freund's Adjuvant (CFA) in order to induce arthritis. Specifically, mice are injected intradermally/subcutaneously with G6PI in CFA on Day 0 and develop clinical signs of arthritis within days of the immunization. As with the CIA model discussed above, mice are treated with xceptor, vehicle (PBS), or negative or positive control in a preventative and/or therapeutic regimen. Preventative treatment starts on Day 0 and continues through the peak of disease in control mice. Therapeutic treatment starts when the majority of mice show mild signs of arthritis. Enbrel®, which has been shown to have good efficacy in both the CIA and G6PI-induced models of arthritis, is used as a positive control. Data collected in every experiment includes clinical scores and cumulative incidence of arthritis. Clinical signs of arthritis in the G6PI model are scored using a scale similar to that employed for the CIA model.

While this invention has been described in conjunction with the specific embodiments outlined herein, it is evident that many alternatives, modifications and variations will be apparent to those skilled in the art. Accordingly, the embodiments of this disclosure as set forth above are intended to be illustrative, not limiting. Various changes may be made without departing from the spirit and scope of this disclosure as defined in the following claims. All of the patents, patent application publications, patent applications, and non-patent publications referred to in this specification and/or listed in the Application Data Sheet, are incorporated herein by reference, in their entirety.

SEQUENCE LISTING (422 sequences)

SEQ ID NO: 1 - protein, 161 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSD

SEQ ID NO: 2 - protein, 152 aa, Homo sapiens
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 3 - protein, 115 aa, Homo sapiens
AMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGAQIYV

SEQ ID NO: 4 - protein, 7 aa, Homo sapiens
SPGKATE

SEQ ID NO: 5 - protein, 9 aa, Homo sapiens
YMMGNELTF

SEQ ID NO: 6 - protein, 9 aa, Homo sapiens
LMYPPPYYL

SEQ ID NO: 7 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 8 - DNA, 1700 bp, Artificial Sequence
  Polynucleotide coding fusion protein having a CTLA4 ectodomain and an IL10 domain
aagcttgccgccatggaagcaccagcgcagcttctcttcctcctgctactctggctcccagataccaccggtatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaatctagagcggccgc

SEQ ID NO: 9 - protein, 537 aa, Artificial Sequence
  Fusion protein having a CTLA4 ectodomain and an IL10 domain
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 10 - DNA, 1158 bp, Artificial Sequence
  Polynucleotide coding CTLA4-Ig construct
aagcttgccgccatggaagcaccagcgcagcttctcttcctcctgctactctggctcccagataccaccggtatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaatctagagcggccgcc

SEQ ID NO: 11 - protein, 356 aa, Artificial Sequence
  CTLA4-Ig construct
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 12 - DNA, 1880 bp, Artificial Sequence
  Nucleotide expression cassette of a fusion protein having a CTLA4 ectodomain and a PDL1 domain
aagcttgccgccatggaagcaccagcgcagcttctcttcctcctgctactctggctcccagataccaccggtatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattcttttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggtaatctagagcggccgc

SEQ ID NO: 13 - protein, 597 aa, Artificial Sequence
  Fusion protein having a CTLA4 ectodomain and a PDL1 domain
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 14 - protein, 338 aa, Homo sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 15 - protein, 318 aa, Homo sapiens
MVVMAPRTLFLLLSGALTLTETWGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWSKEGDGGIMSVRESRSLSEDL

SEQ ID NO: 16 - DNA, 2105 bp, Artificial Sequence
  Nucleotide expression cassette of a fusion protein having a CTLA4 ectodomain and an HLA-G5 domain
aagcttgccgccatggaagcaccagcgcagcttctcttcctcctgctactctggctcccagataccaccggtatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcaccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggagtaaggagggagatggaggcatcatgtctgttagggaaagcaggagcctctctgaagacctttaatctagagcggccgc

SEQ ID NO: 17 - protein, 672 aa, Artificial Sequence [sequence omitted]

SEQ ID NO: 18 - protein, 728 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 19 - protein, 290 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 20 - protein, 723 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 21 - protein, 285 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCET

SEQ ID NO: 22 - protein, 210 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEGK

SEQ ID NO: 23 - DNA, 3794 bp, Artificial Sequence
  Nucleotide expression cassette of a fusion protein having a CTLA4 ectodomain and an HGF domain
aagcttgccgccatggaagcaccagcgcagcttctcttcctcctgctactctggctcccagataccaccggtatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaatctagagcggccgccaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatag

SEQ ID NO: 24 - protein, 1074 aa, Artificial Sequence [sequence omitted]

SEQ ID NO: 25 - protein, 229 aa, Homo sapiens
MTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 26 - protein, 253 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 27 - DNA, 2486 bp, Artificial Sequence
  Nucleotide expression cassette of a fusion protein having a CTLA4 ectodomain and an IL35 domain
aagcttgccgccatggaagcaccagcgcagcttctcttcctcctgctactctggctcccagataccaccggtatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctaggaaagggcccccagcagctctgacactgccccgggtgcaatgccgagcctctcggtacccgatcgccgtggattgctcctggaccctgccgcctgctccaaactccaccagccccgtgtccttcattgccacgtacaggctcggcatggctgcccggggccacagctggccctgcctgcagcagacgccaacgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccagctacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacgtccaagtggcggctcaggacctcacagactacggggaactgagtgactggagtctccccgccactgccacaatgagcctgggcaagggcggaggctcagggggtggctctggaggcggctccggagggggatctagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaatctagagcggccgc

SEQ ID NO: 28 - protein, 799 aa, Artificial Sequence
  Fusion protein having a CTLA4 ectodomain and an IL35 domain
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGKGGGSGGGSGGGSGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 29 - protein, 200 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSH

SEQ ID NO: 30 - DNA, 1707 bp, Artificial Sequence
  Nucleotide expression cassette of a fusion protein having a CTLA4 ectodomain and an HVEM ectodomain
aagcttgccgccatggaagcaccagcgcagcttctcttcctcctgctactctggctcccagataccaccggtatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactaaatctagagcggccgc

SEQ ID NO: 31 - protein, 539 aa, Artificial Sequence
  Fusion protein having a CTLA4 ectodomain and an HVEM ectodomain
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSLPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSH

SEQ ID NO: 32 - protein, 238 aa, Homo sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 33 - protein, 230 aa, Homo sapiens
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFC

SEQ ID NO: 34 - DNA, 1823 bp, Artificial Sequence
  Nucleotide expression cassette of a fusion protein having a CTLA4 ectodomain and an PDL2 domain
aagcttgccgccatggaagcaccagcgcagcttctcttcctcctgctactctggctcccagataccaccggtatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgaccctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttaatctagagcggccgc

SEQ ID NO: 35 - protein, 578 aa, Artificial Sequence
  Fusion protein having a CTLA4 ectodomain and an PDL2 domain
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSLFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 36-38 - skipped (3 entries)

SEQ ID NO: 39 - protein, 164 aa, Homo sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLG

SEQ ID NO: 40 - protein, 255 aa, Homo sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCCWRCRRRPKTPEAASSPRKSGASDRQRRRGGWETCGCEPGRPPGPPTAASPSPGAPQAAGALRSALGRALLPWQQKWVQEGGSDQRPGPCSSAAAAGPCRRERETQSWPPSSLAGPDGVGS

SEQ ID NO: 41 - DNA, 1631 bp, Artificial Sequence
  Nucleotide expression cassette of a fusion protein having a CTLA4 ectodomain and an GITR domain
aagcttgccgccatggaagcaccagcgcagcttctcttcctcctgctactctggctcccagataccaccggtatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtcccccccggcagagccgcttgggtaagcggccgc

SEQ ID NO: 42 - protein, 516 aa, Artificial Sequence
  Fusion protein having a CTLA4 ectodomain and an GITR domain
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLG

SEQ ID NO: 43 - protein, 2 aa, Artificial Sequence
  Linker
NS

SEQ ID NO: 44 - protein, 6 aa, Artificial Sequence
  Linker
SCPPCP

SEQ ID NO: 45 - protein, 8 aa, Artificial Sequence
  Linker
GGGGSGNS

SEQ ID NO: 46 - protein, 8 aa, Artificial Sequence
  Linker
GCPPCPNS

SEQ ID NO: 47 - protein, 8 aa, Artificial Sequence
  Linker
GSPPSPNS

SEQ ID NO: 48 - protein, 8 aa, Artificial Sequence
  Linker
GSPPSPNS

SEQ ID NO: 49 - protein, 8 aa, Artificial Sequence
  Linker
GCPPCPNS

SEQ ID NO: 50 - protein, 8 aa, Artificial Sequence
  Linker
GCPPCPNS

SEQ ID NO: 51 - protein, 9 aa, Artificial Sequence
  Linker
GCPPCPGNS

SEQ ID NO: 52 - protein, 9 aa, Artificial Sequence
  Linker
GCPPCPANS

SEQ ID NO: 53 - protein, 9 aa, Artificial Sequence
  Linker
GCPPCPANS

SEQ ID NO: 54 - protein, 9 aa, Artificial Sequence
  Linker
EEEEDEGNS

SEQ ID NO: 55 - protein, 10 aa, Artificial Sequence
  Linker
NYGGGGSGNS

SEQ ID NO: 56 - protein, 10 aa, Artificial Sequence
  Linker
VSERPFPPNS

SEQ ID NO: 57 - protein, 11 aa, Artificial Sequence
  Linker
EPKSCDKTCCP

SEQ ID NO: 58 - protein, 11 aa, Artificial Sequence
  Linker
SQPEIVPISNS

SEQ ID NO: 59 - protein, 12 aa, Artificial Sequence
  Linker
GGGGSCPPCPNS

SEQ ID NO: 60 - protein, 12 aa, Artificial Sequence
  Linker
KADFLTPSIGNS

SEQ ID NO: 61 - protein, 12 aa, Artificial Sequence
  Linker
QMNSELSVLANS

SEQ ID NO: 62 - protein, 13 aa, Artificial Sequence
  Linker
EPKSCDKTHTCCP

SEQ ID NO: 63 - protein, 13 aa, Artificial Sequence
  Linker
EPKSCDKTCPPCP

SEQ ID NO: 64 - protein, 13 aa, Artificial Sequence
  Linker
GGGGSGGGGSGNS

SEQ ID NO: 65 - protein, 13 aa, Artificial Sequence
  Linker
GCPPCPGGGGSNS

SEQ ID NO: 66 - protein, 13 aa, Artificial Sequence
  Linker
GGGGSCPPCPGNS

SEQ ID NO: 67 - protein, 13 aa, Artificial Sequence
  Linker
GCPPCPGGGGSNS

SEQ ID NO: 68 - protein, 13 aa, Artificial Sequence
  Linker
GGGASCPPCPGNS

SEQ ID NO: 69 - protein, 13 aa, Artificial Sequence
  Linker
GGGASCPPCAGNS

SEQ ID NO: 70 - protein, 13 aa, Artificial Sequence
  Linker
GGGASCPPCAGNS

SEQ ID NO: 71 - protein, 15 aa, Artificial Sequence
  Linker
NYGGGGSGGGGSGNS

SEQ ID NO: 72 - protein, 15 aa, Artificial Sequence
  Linker
LSVKADFLTPSIGNS

SEQ ID NO: 73 - protein, 15 aa, Artificial Sequence
  Linker
LSVLANFSQPEIGNS

SEQ ID NO: 74 - protein, 15 aa, Artificial Sequence
  Linker
LKIQERVSKPKISNS

SEQ ID NO: 75 - protein, 15 aa, Artificial Sequence
  Linker
LDVSERPFPPHIQNS

SEQ ID NO: 76 - protein, 15 aa, Artificial Sequence
  Linker
REQLAEVTLSLKANS

SEQ ID NO: 77 - protein, 15 aa, Artificial Sequence
  Linker
RIHQMNSELSVLANS

SEQ ID NO: 78 - protein, 15 aa, Artificial Sequence
  Linker
DTKGKNVLEKIFSNS

SEQ ID NO: 79 - protein, 15 aa, Artificial Sequence
  Linker
LPPETQESQEVTLNS

SEQ ID NO: 80 - protein, 15 aa, Artificial Sequence
  Linker
RIHLNVSERPFPPNS

SEQ ID NO: 81 - protein, 15 aa, Artificial Sequence
  Linker
LSVKADFLTPSIGNS

SEQ ID NO: 82 - protein, 15 aa, Artificial Sequence
  Linker
LSVLANFSQPEIGNS

SEQ ID NO: 83 - protein, 15 aa, Artificial Sequence
  Linker
LSVLANFSQPEIGNS

SEQ ID NO: 84 - protein, 15 aa, Artificial Sequence
  Linker
RIHQMNSELSVLANS

SEQ ID NO: 85 - protein, 15 aa, Artificial Sequence
  Linker
KPFFTCGSADTCPNS

SEQ ID NO: 86 - protein, 15 aa, Artificial Sequence
  Linker
KPFFTCGSADTCPNS

SEQ ID NO: 87 - protein, 15 aa, Artificial Sequence
  Linker
QYNCPGQYTFSMPNS

SEQ ID NO: 88 - protein, 15 aa, Artificial Sequence
  Linker
GGGGSGGGGSGGGGS

SEQ ID NO: 89 - protein, 15 aa, Artificial Sequence
  Linker
EPKSSDKTHTCPPCP

SEQ ID NO: 90 - protein, 15 aa, Artificial Sequence
  Linker
EPKSSDKTHTCPPCS

SEQ ID NO: 91 - protein, 15 aa, Artificial Sequence
  Linker
EPKSCDKTHTSPPCS

SEQ ID NO: 92 - protein, 15 aa, Artificial Sequence
  Linker
EPKSCDKTHTCPPCP

SEQ ID NO: 93 - protein, 15 aa, Artificial Sequence
  Linker
EPKSCDKTHTSPPSS

SEQ ID NO: 94 - protein, 15 aa, Artificial Sequence
  Linker
PRGPTIKPCPPCKCP

SEQ ID NO: 95 - protein, 15 aa, Artificial Sequence
  Linker
EPKSSDKTHTSPPSS

SEQ ID NO: 96 - protein, 15 aa, Artificial Sequence
  Linker
EPKSSDKTHTSPPCS

SEQ ID NO: 97 - protein, 15 aa, Artificial Sequence
  Linker
EPKSSDKTHTCPPSS

SEQ ID NO: 98 - protein, 15 aa, Artificial Sequence
  Linker
EPKSCDKTHTSPPCP

SEQ ID NO: 99 - protein, 15 aa, Artificial Sequence
  Linker
EPKSSDKTHTSPPSP

SEQ ID NO: 100 - protein, 15 aa, Artificial Sequence
  Linker
EPKSSDKTHTSPPCP

SEQ ID NO: 101 - protein, 15 aa, Artificial Sequence
  Linker
EPKSCDKTHTSPPSP

SEQ ID NO: 102 - protein, 15 aa, Artificial Sequence
  Linker
EPKSSDKTHTCPPSP

SEQ ID NO: 103 - protein, 15 aa, Artificial Sequence
  Linker
GGGGCDKTHTCPPCP

SEQ ID NO: 104 - protein, 15 aa, Artificial Sequence
  Linker
EPKSCGGGGGCPPCP

SEQ ID NO: 105 - protein, 15 aa, Artificial Sequence
  Linker
EPKSCDKTHTCGGCP

SEQ ID NO: 106 - protein, 15 aa, Artificial Sequence
  Linker
EPKSCDKTHTCPPCG

SEQ ID NO: 107 - protein, 15 aa, Artificial Sequence
  Linker
EPKSCDKTHTCPPSP

SEQ ID NO: 108 - protein, 15 aa, Artificial Sequence
  Linker
EPKSCDKCHTCPPCP

SEQ ID NO: 109 - protein, 15 aa, Artificial Sequence
  Linker
EPKSCDKTCCCPPCP

SEQ ID NO: 110 - protein, 15 aa, Artificial Sequence
  Linker
EPKSCPPPPPCPPCP

SEQ ID NO: 111 - protein, 15 aa, Artificial Sequence
  Linker
PPPPCDKTHTCPPCP

SEQ ID NO: 112 - protein, 15 aa, Artificial Sequence
  Linker
EPKSCDKTHTCWWCP

SEQ ID NO: 113 - protein, 15 aa, Artificial Sequence
  Linker
EPKSCDWWHTCPPCP

SEQ ID NO: 114 - protein, 15 aa, Artificial Sequence
  Linker
EPKCSDKTHTCPPCP

SEQ ID NO: 115 - protein, 15 aa, Artificial Sequence
  Linker
EPKSDCKTHTCPPCP

SEQ ID NO: 116 - protein, 15 aa, Artificial Sequence
  Linker
EPKSDCWWHTCPPCP

SEQ ID NO: 117 - protein, 15 aa, Artificial Sequence
  Linker
EPKSCDFFHTCPPCP

SEQ ID NO: 118 - protein, 15 aa, Artificial Sequence
  Linker
EPKSCDWWWTCPPCP

SEQ ID NO: 119 - protein, 15 aa, Artificial Sequence
  Linker
EPKSCWWTHTCPPCP

SEQ ID NO: 120 - protein, 15 aa, Artificial Sequence
  Linker
EPWWCDKTHTCPPCP

SEQ ID NO: 121 - protein, 16 aa, Artificial Sequence
  Linker
SQPEIVPISCPPCPNS

SEQ ID NO: 122 - protein, 17 aa, Artificial Sequence
  Linker
TGEPKSSDKTHTCPPCP

SEQ ID NO: 123 - protein, 17 aa, Artificial Sequence
  Linker
EPKSTDKTHTCPPCPNS

SEQ ID NO: 124 - protein, 17 aa, Artificial Sequence
  Linker
EPKSTDKTHTSPPSPNS

SEQ ID NO: 125 - protein, 17 aa, Artificial Sequence
  Linker
EPKSTDKTHTCPPCPNS

SEQ ID NO: 126 - protein, 17 aa, Artificial Sequence
  Linker
EPKSSDKTHTCPPCPNS

SEQ ID NO: 127 - protein, 18 aa, Artificial Sequence
  Linker
EPKSCDKTHTCPGGGPCP

SEQ ID NO: 128 - protein, 18 aa, Artificial Sequence
  Linker
EPKSCDGGGKTHTCPPCP

SEQ ID NO: 129 - protein, 18 aa, Artificial Sequence
  Linker
EPKSCDPPPKTHTCPPCP

SEQ ID NO: 130 - protein, 18 aa, Artificial Sequence
  Linker
EPKSCDKTHTCPPPPPCP

SEQ ID NO: 131 - protein, 18 aa, Artificial Sequence
  Linker
GGGGSGGGGSGGGGSGNS

SEQ ID NO: 132 - protein, 19 aa, Artificial Sequence
  Linker
NYGGGGSGGGGSGGGGSNS

SEQ ID NO: 133 - protein, 19 aa, Artificial Sequence
  Linker
LSVKADFLTPSISPPCPNS

SEQ ID NO: 134 - protein, 19 aa, Artificial Sequence
  Linker
SVLANFSQPEISCPPCPNS

SEQ ID NO: 135 - protein, 20 aa, Artificial Sequence
  Linker
GQRHNNSSLNTRTQKARHSP

SEQ ID NO: 136 - protein, 20 aa, Artificial Sequence
  Linker
LSVLANFSQPEISCPPCPNS

SEQ ID NO: 137 - protein, 20 aa, Artificial Sequence
  Linker
LKIQERVSKPKISCPPCPNS

SEQ ID NO: 138 - protein, 20 aa, Artificial Sequence
  Linker
REQLAEVTLSLKACPPCPNS

SEQ ID NO: 139 - protein, 20 aa, Artificial Sequence
  Linker
RIHQMNSELSVLACPPCPNS

SEQ ID NO: 140 - protein, 20 aa, Artificial Sequence
  Linker
RIHLNVSERPFPPCPPCPNS

SEQ ID NO: 141 - protein, 20 aa, Artificial Sequence
  Linker
NSLFNQEVQIPLTESYCPNS

SEQ ID NO: 142 - protein, 20 aa, Artificial Sequence
  Linker
EEEEDEEDEEDEEEEEDGNS

SEQ ID NO: 143 - protein, 21 aa, Artificial Sequence
  Linker
LDVSERPFPPHIQSCPPCPNS

SEQ ID NO: 144 - protein, 21 aa, Artificial Sequence
  Linker
DTKGKNVLEKIFDSCPPCPNS

SEQ ID NO: 145 - protein, 21 aa, Artificial Sequence
  Linker
LPPETQESQEVTLSCPPCPNS

SEQ ID NO: 146 - protein, 21 aa, Artificial Sequence
  Linker
EPAFTPGPNIELQKDSDCPNS

SEQ ID NO: 147 - protein, 21 aa, Artificial Sequence
  Linker
QRHNNSSLNTRTQKARHCPNS

SEQ ID NO: 148 - protein, 21 aa, Artificial Sequence
  Linker
QRHNNSSLNTRTQKARHSPNS

SEQ ID NO: 149 - protein, 36 aa, Artificial Sequence
  Linker
NYGGGGSGGGGSGGGGSNYGGGGSGGGGSGGGGSNS

SEQ ID NO: 150 - protein, 122 aa, Artificial Sequence
  Linker
RTRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPNS

SEQ ID NO: 151 - protein, 13 aa, Artificial Sequence
  Linker
GGGASCPPCAGNS

SEQ ID NO: 152 - protein, 39 aa, Artificial Sequence
  Linker
NNYGGGGSGGGGSGGGGSGNYGGGGSGGGGSGGGGSGNS

SEQ ID NO: 153 - protein, 20 aa, Artificial Sequence
  Linker
NYGGGGSGGGGSGGGGSGNS

SEQ ID NO: 154 - protein, 7 aa, Artificial Sequence
  Linker
SPPSPNS

SEQ ID NO: 155 - protein, 17 aa, Artificial Sequence
  Linker
EPTSTDKTHTSPPSPNS

SEQ ID NO: 156 - protein, 17 aa, Artificial Sequence
  Linker
EPTSTDKTHTCPPCPNS

SEQ ID NO: 157 - protein, 19 aa, Artificial Sequence
  Linker
LSVKADFLTPSISPPCPNS

SEQ ID NO: 158 - protein, 12 aa, Artificial Sequence
  Linker
GGGASCPPCANS

SEQ ID NO: 159 - protein, 22 aa, Artificial Sequence
  Linker
RTQRHNNSSLNTRTQKARHSGH

SEQ ID NO: 160 - protein, 118 aa, Artificial Sequence
  Linker
RTRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTC

SEQ ID NO: 161 - protein, 35 aa, Artificial Sequence
  Linker
RTQSEEQQRRALEQKLSNMENRLKPFFTCGSADTC

SEQ ID NO: 162 - protein, 25 aa, Artificial Sequence
  Linker
RTEQKLSNMENRLKPFFTCGSADTC

SEQ ID NO: 163 - protein, 26 aa, Artificial Sequence
  Linker
SGGGGSGGGGSGGGGSGGGGSGGGGS

SEQ ID NO: 164 - protein, 16 aa, Artificial Sequence
  Linker
GGGGSGGGGSGGGGAS

SEQ ID NO: 165 - protein, 16 aa, Artificial Sequence
  Linker
SEPKSSDKTHTCPPCP

SEQ ID NO: 166 - protein, 18 aa, Artificial Sequence
  Linker
GDQEPKSSDKTHTSPPCP

SEQ ID NO: 167 - protein, 22 aa, Artificial Sequence
  Heterologous leader sequence
MDFQVQIFSFLLISASVIMSRG

SEQ ID NO: 168 - protein, 20 aa, Artificial Sequence
  Heterologous leader sequence
MEAPAQLLFLLLLWLPDTTG

SEQ ID NO: 169 - DNA, 60 bp, Artificial Sequence
  Polynucleotide coding a heterologous leader sequence
atggaagcaccagcgcagcttctcttcctcctgctactctggctcccagataccaccggt

SEQ ID NO: 170 - DNA, 1611 bp, Artificial Sequence
  Nucleotide sequence encoding a CTLA4::IL10 fusion protein with H68 linker
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 171 - protein, 536 aa, Artificial Sequence
  A CTLA4::IL10 fusion protein with H68 linker
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 172 - DNA, 1614 bp, Artificial Sequence
  Nucleotide sequence encoding a CTLA4::IL10 fusion protein with H75 linker
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaggaactcagatggcaggtcattctccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 173 - protein, 537 aa, Artificial Sequence
  A CTLA4::IL10 fusion protein with H75 linker
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTGTQMAGHSPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 174 - DNA, 1602 bp, Artificial Sequence
  Nucleotide sequence encoding a CTLA4::IL10 fusion protein with H77 linker
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 175 - protein, 533 aa, Artificial Sequence
  A CTLA4::IL10 fusion protein with H77 linker
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTEPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 176 - DNA, 1593 bp, Artificial Sequence
  Nucleotide sequence encoding a CTLA4::IL10 fusion protein with H78 linker
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 177 - protein, 530 aa, Artificial Sequence
  A CTLA4::IL10 fusion protein with H78 linker
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 178 - DNA, 1584 bp, Artificial Sequence
  Nucleotide sequence encoding a CTLA4::IL10 fusion protein with H79 linker
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 179 - protein, 527 aa, Artificial Sequence
  A CTLA4::IL10 fusion protein with H79 linker
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 180 - DNA, 1629 bp, Artificial Sequence
  Nucleotide sequence encoding a CTLA4::monoIL10 fusion protein
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacggtggtggatccggcggtaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 181 - protein, 542 aa, Artificial Sequence
  A CTLA4::monoIL10 fusion protein
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 182 - DNA, 2013 bp, Artificial Sequence
  Nucleotide sequence encoding IL10::FUN1 fusion protein
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctgaggtccaactgcagcagtctggacctgagctggagaagcctggcgcttcagtgaagatatcctgcaaggcttctggttactcattcactgactacaacatgaactgggtgaagcagagcaatggaaagagccttgagtggattggaaatattgatccttactatggtggtactagttacaatcagaagttcaagggcaaggccacattgactgtagacaaatcctccagcacagcctacatgcagctcaacagcctgacatctgaagactctgcagtctatttctgtgcaagatgggactataggtacgacgacgggagggcttactatgttatggacttctggggtcaaggaacctcagtcaccgtctcctcagggggtggaggctctggtggcggtggctctggcggaggtggatccggtggcggcggatctgagctccagatgacccagtctccatcatctctggctgcgtctgcaggagaaaaggtcactatgagctgtaagtccagtcaaagtgttttatacagttcaaatcagaagaactacttggcctggtaccagcagaaaccagggcagtctcctaaactgctgatctactgggcatccactagggaatctggtgtccctgatcgcttcacaggcagtggatctgggacacattttactctgaccgtcagcagtgtgcaagctgaagacctggcagtttattactgtcatcaatacctctactcgtggacgttcggtggaggcaccaacctggaaatcaaacggtaa

SEQ ID NO: 183 - protein, 670 aa, Artificial Sequence
  IL10::FUN1 fusion protein
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSEVQLQQSGPELEKPGASVKISCKASGYSFTDYNMNWVKQSNGKSLEWIGNIDPYYGGTSYNQKFKGKATLTVDKSSSTAYMQLNSLTSEDSAVYFCARWDYRYDDGRAYYVMDFWGQGTSVTVSSGGGGSGGGGSGGGGSGGGGSELQMTQSPSSLAASAGEKVTMSCKSSQSVLYSSNQKNYLAWYQQKPGQSPKLLIYWASTRESGVPDRFTGSGSGTHFTLTVSSVQAEDLAVYYCHQYLYSWTFGGGTNLEIKR

SEQ ID NO: 184 - DNA, 1983 bp, Artificial Sequence
  Nucleotide sequence encoding IL10::3D1 fusion protein
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctcaggtccagctgcagcagtctgggcctgagctggtgaggcctggggaatcagtgaagatttcctgcaagggttccggctacacattcactgattatgctatacagtgggtgaagcagagtcatgcaaagagtctagagtggattggagttattaatatttactatgataatacaaactacaaccagaagtttaagggcaaggccacaatgactgtagacaaatcctccagcacagcctatatggaacttgccagattgacatctgaggattctgccatctattactgtgcaagagcggcctggtatatggactactggggtcaaggaacctcagtcaccgtctcctcagggggtggaggctctggtggcggtggctctggcggaggtggatccggtggcggcggatctgacattgtgctgtcacagtctccatcctccctggctgtgtcagcaggagagaaggtcactatgagctgcaaatccagtcagagtctgctcaacagtagaacccgagagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcacgcaatcttataatctttacacgttcggaggggggaccaagctggaaataaaataa

SEQ ID NO: 185 - protein, 660 aa, Artificial Sequence
  IL10::3D1 fusion protein
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSQVQLQQSGPELVRPGESVKISCKGSGYTFTDYAIQWVKQSHAKSLEWIGVINIYYDNTNYNQKFKGKATMTVDKSSSTAYMELARLTSEDSAIYYCARAAWYMDYWGQGTSVTVSSGGGGSGGGGSGGGGSGGGGSDIVLSQSPSSLAVSAGEKVTMSCKSSQSLLNSRTRENYLAWYQQKPGQSPKLLIYWASTRESGVPDRFTGSGSGTDFTLTISSVQAEDLAVYYCTQSYNLYTFGGGTKLEIK

SEQ ID NO: 186 - DNA, 2013 bp, Artificial Sequence
  Nucleotide sequence encoding FUN1::IL10 fusion protein
gaggtccaactgcagcagtctggacctgagctggagaagcctggcgcttcagtgaagatatcctgcaaggcttctggttactcattcactgactacaacatgaactgggtgaagcagagcaatggaaagagccttgagtggattggaaatattgatccttactatggtggtactagttacaatcagaagttcaagggcaaggccacattgactgtagacaaatcctccagcacagcctacatgcagctcaacagcctgacatctgaagactctgcagtctatttctgtgcaagatgggactataggtacgacgacgggagggcttactatgttatggacttctggggtcaaggaacctcagtcaccgtctcctcagggggtggaggctctggtggcggtggctctggcggaggtggatccggtggcggcggatctgagctccagatgacccagtctccatcatctctggctgcgtctgcaggagaaaaggtcactatgagctgtaagtccagtcaaagtgttttatacagttcaaatcagaagaactacttggcctggtaccagcagaaaccagggcagtctcctaaactgctgatctactgggcatccactagggaatctggtgtccctgatcgcttcacaggcagtggatctgggacacattttactctgaccgtcagcagtgtgcaagctgaagacctggcagtttattactgtcatcaatacctctactcgtggacgttcggtggaggcaccaacctggaaatcaaacggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 187 - protein, 670 aa, Artificial Sequence
  FUN1::IL10 fusion protein
EVQLQQSGPELEKPGASVKISCKASGYSFTDYNMNWVKQSNGKSLEWIGNIDPYYGGTSYNQKFKGKATLTVDKSSSTAYMQLNSLTSEDSAVYFCARWDYRYDDGRAYYVMDFWGQGTSVTVSSGGGGSGGGGSGGGGSGGGGSELQMTQSPSSLAASAGEKVTMSCKSSQSVLYSSNQKNYLAWYQQKPGQSPKLLIYWASTRESGVPDRFTGSGSGTHFTLTVSSVQAEDLAVYYCHQYLYSWTFGGGTNLEIKRLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 188 - DNA, 1983 bp, Artificial Sequence
  Nucleotide sequence encoding 3D1::IL10 fusion protein
caggtccagctgcagcagtctgggcctgagctggtgaggcctggggaatcagtgaagatttcctgcaagggttccggctacacattcactgattatgctatacagtgggtgaagcagagtcatgcaaagagtctagagtggattggagttattaatatttactatgataatacaaactacaaccagaagtttaagggcaaggccacaatgactgtagacaaatcctccagcacagcctatatggaacttgccagattgacatctgaggattctgccatctattactgtgcaagagcggcctggtatatggactactggggtcaaggaacctcagtcaccgtctcctcagggggtggaggctctggtggcggtggctctggcggaggtggatccggtggcggcggatctgacattgtgctgtcacagtctccatcctccctggctgtgtcagcaggagagaaggtcactatgagctgcaaatccagtcagagtctgctcaacagtagaacccgagagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcacgcaatcttataatctttacacgttcggaggggggaccaagctggaaataaaactcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 189 - protein, 660 aa, Artificial Sequence
  3D1::IL10 fusion protein
QVQLQQSGPELVRPGESVKISCKGSGYTFTDYAIQWVKQSHAKSLEWIGVINIYYDNTNYNQKFKGKATMTVDKSSSTAYMELARLTSEDSAIYYCARAAWYMDYWGQGTSVTVSSGGGGSGGGGSGGGGSGGGGSDIVLSQSPSSLAVSAGEKVTMSCKSSQSLLNSRTRENYLAWYQQKPGQSPKLLIYWASTRESGVPDRFTGSGSGTDFTLTISSVQAEDLAVYYCTQSYNLYTFGGGTKLEIKLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 190 - DNA, 1611 bp, Artificial Sequence
  Nucleotide sequence encoding CTLA4::IL10 I87A fusion protein
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 191 - protein, 536 aa, Artificial Sequence
  CTLA4::IL10 I87A fusion protein
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSSPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYMTMKIRN

SEQ ID NO: 192 - DNA, 1611 bp, Artificial Sequence
  Nucleotide sequence encoding CTLA4::IL10 I87S fusion protein
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacagcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 193 - protein, 536 aa, Artificial Sequence
  CTLA4::IL10 I87S fusion protein
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSSPGQGTQSENSCTHFPGNLPNMLRDLRDAFSRVKTFFQMKDQLDNLLLKESLLEDFKGYLGCQALSEMIQFYLEEVMPQAENQDPDSKAHVNSLGENLKTLRLRLRRCHRFLPCENKSKAVEQVKNAFNKLQEKGIYKAMSEFDIFINYIEAYMTMKIRN

SEQ ID NO: 194 - DNA, 1635 bp, Artificial Sequence
  Nucleotide sequence encoding mouse CTLA4::mouse IL10 fusion protein with H68 linker
gccatacaggtgacccaaccttcagtggtgttggctagcagccatggtgtcgccagctttccatgtgaatattcaccatcacacaacactgatgaggtccgggtgactgtgctgcggcagacaaatgaccaaatgactgaggtctgtgccacgacattcacagagaagaatacagtgggcttcctagattaccccttctgcagtggtacctttaatgaaagcagagtgaacctcaccatccaaggactgagagctgttgacacgggactgtacctctgcaaggtggaactcatgtacccaccgccatactttgtgggcatgggcaacgggacgcagatttatgtcattgatccagaaccatgcccggattctgacctcgagcccagagtgcccataacacagaacccctgtcctccactcaaagagtgtcccccatgcgcagctccagacgcagcgggtgcgccatccgtcttcatcttccctccaaagatcaaggatgtactcatgatctccctgagccccatggtcacatgtgtggtggtggatgtgagcgaggatgacccagacgtccagatcagctggtttgtgaacaacgtggaagtacacacagctcagacacaaacccatagagaggattacaacagtactctccgggtggtcagtgccctccccatccagcaccaggactggatgagtggcaaggcgttcgcatgcgcggtcaacaacagagccctcccatcccccatcgagaaaaccatctcaaaacccagagggccagtaagagctccacaggtatatgtcttgcctccaccagcagaagagatgactaagaaagagttcagtctgacctgcatgatcgcaggcttcttacctgccgaaattgctgtggactggaccagcaatgggcgtacagagcaaaactacaagaacaccgcaacagtcctggactctgatggttcttacttcatgtacagcaagctcagagtacaaaagagcacttgggaaagaggaagtcttttcgcctgctcagtggtccacgagggtctgcacaatcaccttacgactaagaccatctcccggtctctgggtaaaaactcattattcaaccaagaagttcaaattcccttgaccgaaagttacagcccgaattctagcaggggccagtacagccgggaagacaataactgcacccacttcccagtcggccagagccacatgctcctagagctgcggactgccttcagccaggtgaagactttctttcaaacaaaggaccagctggacaacatactgctaaccgactccttaatgcaggactttaagggttacttgggttgccaagccttatcggaaatgatccagttttacctggtagaagtgatgccccaggcagagaagcatggcccagaaatcaaggagcatttgaactccctgggtgagaagctgaagaccctcaggatgcggctgaggcgctgtcatcgatttctcccctgtgaaaataagagcaaggcagtggagcaggtgaagagtgattttaataagctccaagaccaaggtgtctacaaggccatgaatgaatttgacatcttcatcaactgcatagaagcatacatgatgatcaaaatgaaaagctaa

SEQ ID NO: 195 - protein, 544 aa, Artificial Sequence
  mouse CTLA4::mouse IL10 fusion protein with H68 linker
AIQVTQPSVVLASSHGVASFPCEYSPSHNTDEVRVTVLRQTNDQMTEVCATTFTEKNTVGFLDYPFCSGTFNESRVNLTIQGLRAVDTGLYLCKVELMYPPPYFVGMGNGTQIYVIDPEPCPDSDLEPRVPITQNPCPPLKECPPCAAPDAAGAPSVFIFPPKIKDVLMISLSPMVTCVVVDVSEDDPDVQISWFVNNVEVHTAQTQTHREDYNSTLRVVSALPIQHQDWMSGKAFACAVNNRALPSPIEKTISKPRGPVRAPQVYVLPPPAEEMTKKEFSLTCMIAGFLPAEIAVDWTSNGRTEQNYKNTATVLDSDGSYFMYSKLRVQKSTWERGSLFACSVVHEGLHNHLTTKTISRSLGKNSLFNQEVQIPLTESYSPNSSRGQYSREDNNCTHFPVGQSHMLLELRTAFSQVKTFFQTKDQLDNILLTDSLMQDFKGYLGCQALSEMIQFYLVEVMPQAEKHGPEIKEHLNSLGEKLKTLRMRLRRCHRFLPCENKSKAVEQVKSDFNKLQDQGVYKAMNEFDIFINCIEAYMMIKMKS

SEQ ID NO: 196 - DNA, 1638 bp, Artificial Sequence
  Nucleotide sequence encoding mouse CTLA4::mouse IL10 fusion protein with H75 linker
gccatacaggtgacccaaccttcagtggtgttggctagcagccatggtgtcgccagctttccatgtgaatattcaccatcacacaacactgatgaggtccgggtgactgtgctgcggcagacaaatgaccaaatgactgaggtctgtgccacgacattcacagagaagaatacagtgggcttcctagattaccccttctgcagtggtacctttaatgaaagcagagtgaacctcaccatccaaggactgagagctgttgacacgggactgtacctctgcaaggtggaactcatgtacccaccgccatactttgtgggcatgggcaacgggacgcagatttatgtcattgatccagaaccatgcccggattctgacctcgagcccagagtgcccataacacagaacccctgtcctccactcaaagagtgtcccccatgcgcagctccagacgcagcgggtgcgccatccgtcttcatcttccctccaaagatcaaggatgtactcatgatctccctgagccccatggtcacatgtgtggtggtggatgtgagcgaggatgacccagacgtccagatcagctggtttgtgaacaacgtggaagtacacacagctcagacacaaacccatagagaggattacaacagtactctccgggtggtcagtgccctccccatccagcaccaggactggatgagtggcaaggcgttcgcatgcgcggtcaacaacagagccctcccatcccccatcgagaaaaccatctcaaaacccagagggccagtaagagctccacaggtatatgtcttgcctccaccagcagaagagatgactaagaaagagttcagtctgacctgcatgatcacaggcttcttacctgccgaaattgctgtggactggaccagcaatgggcgtacagagcaaaactacaagaacaccgcaacagtcctggactctgatggttcttacttcatgtacagcaagctcagagtacaaaagagcacttgggaaagaggaagtcttttcgcctgctcagtggtccacgagggtctgcacaatcaccttacgactaagaccatctcccggtctctgggtaaacagaggcacaacaattcttccctgaatacaggaactcagatggcaggtcattctccgaattctagcaggggccagtacagccgggaagacaataactgcacccacttcccagtcggccagagccacatgctcctagagctgcggactgccttcagccaggtgaagactttctttcaaacaaaggaccagctggacaacatactgctaaccgactccttaatgcaggactttaagggttacttgggttgccaagccttatcggaaatgatccagttttacctggtagaagtgatgccccaggcagagaagcatggcccagaaatcaaggagcatttgaactccctgggtgagaagctgaagaccctcaggatgcggctgaggcgctgtcatcgatttctcccctgtgaaaataagagcaaggcagtggagcaggtgaagagtgattttaataagctccaagaccaaggtgtctacaaggccatgaatgaatttgacatcttcatcaactgcatagaagcatacatgatgatcaaaatgaaaagctaa

SEQ ID NO: 197 - protein, 545 aa, Artificial Sequence
  mouse CTLA4::mouse IL10 fusion protein with H75 linker
AIQVTQPSVVLASSHGVASFPCEYSPSHNTDEVRVTVLRQTNDQMTEVCATTFTEKNTVGFLDYPFCSGTFNESRVNLTIQGLRAVDTGLYLCKVELMYPPPYFVGMGNGTQIYVIDPEPCPDSDLEPRVPITQNPCPPLKECPPCAAPDAAGAPSVFIFPPKIKDVLMISLSPMVTCVVVDVSEDDPDVQISWFVNNVEVHTAQTQTHREDYNSTLRVVSALPIQHQDWMSGKAFACAVNNRALPSPIEKTISKPRGPVRAPQVYVLPPPAEEMTKKEFSLTCMITGFLPAEIAVDWTSNGRTEQNYKNTATVLDSDGSYFMYSKLRVQKSTWERGSLFACSVVHEGLHNHLTTKTISRSLGKQRHNNSSLNTGTQMAGHSPNSSRGQYSREDNNCTHFPVGQSHMLLELRTAFSQVKTFFQTKDQLDNILLTDSLMQDFKGYLGCQALSEMIQFYLVEVMPQAEKHGPEIKEHLNSLGEKLKTLRMRLRRCHRFLPCENKSKAVEQVKSDFNKLQDQGVYKAMNEFDIFINCIEAYMMIKMKS

SEQ ID NO: 198 - DNA, 1920 bp, Artificial Sequence
  Nucleotide sequence encoding GITR::3D1 fusion protein
cagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctcaggtccagctgcagcagtctgggcctgagctggtgaggcctggggaatcagtgaagatttcctgcaagggttccggctacacattcactgattatgctatacagtgggtgaagcagagtcatgcaaagagtctagagtggattggagttattaatatttactatgataatacaaactacaaccagaagtttaagggcaaggccacaatgactgtagacaaatcctccagcacagcctatatggaacttgccagattgacatctgaggattctgccatctattactgtgcaagagcggcctggtatatggactactggggtcaaggaacctcagtcaccgtctcctcagggggtggaggctctggtggcggtggctctggcggaggtggatccggtggcggcggatctgacattgtgctgtcacagtctccatcctccctggctgtgtcagcaggagagaaggtcactatgagctgcaaatccagtcagagtctgctcaacagtagaacccgagagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcacgcaatcttataatctttacacgttcggaggggggaccaagctggaaataaaataa

SEQ ID NO: 199 - protein, 639 aa, Artificial Sequence [sequence omitted]

SEQ ID NO: 200 - DNA, 1989 bp, Artificial Sequence
  Nucleotide sequence encoding HVEM::3D1 fusion protein
ctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctcaggtccagctgcagcagtctgggcctgagctggtgaggcctggggaatcagtgaagatttcctgcaagggttccggctacacattcactgattatgctatacagtgggtgaagcagagtcatgcaaagagtctagagtggattggagttattaatatttactatgataatacaaactacaaccagaagtttaagggcaaggccacaatgactgtagacaaatcctccagcacagcctatatggaacttgccagattgacatctgaggattctgccatctattactgtgcaagagcggcctggtatatggactactggggtcaaggaacctcagtcaccgtctcctcagggggtggaggctctggtggcggtggctctggcggaggtggatccggtggcggcggatctgacattgtgctgtcacagtctccatcctccctggctgtgtcagcaggagagaaggtcactatgagctgcaaatccagtcagagtctgctcaacagtagaacccgagagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcacgcaatcttataatctttacacgttcggaggggggaccaagctggaaataaaataa

SEQ ID NO: 201 - protein, 662 aa, Artificial Sequence
  HVEM::3D1 fusion protein
LPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSQVQLQQSGPELVRPGESVKISCKGSGYTFTDYAIQWVKQSHAKSLEWIGVINIYYDNTNYNQKFKGKATMTVDKSSSTAYMELARLTSEDSAIYYCARAAWYMDYWGQGTSVTVSSGGGGSGGGGSGGGGSGGGGSDIVLSQSPSSLAVSAGEKVTMSCKSSQSLLNSRTRENYLAWYQQKPGQSPKLLIYWASTRESGVPDRFTGSGSGTDFTLTISSVQAEDLAVYYCTQSYNLYTFGGGTKLEIK

SEQ ID NO: 202 - DNA, 2163 bp, Artificial Sequence
  Nucleotide sequence encoding PDL1::3D1 fusion protein
tttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctcaggtccagctgcagcagtctgggcctgagctggtgaggcctggggaatcagtgaagatttcctgcaagggttccggctacacattcactgattatgctatacagtgggtgaagcagagtcatgcaaagagtctagagtggattggagttattaatatttactatgataatacaaactacaaccagaagtttaagggcaaggccacaatgactgtagacaaatcctccagcacagcctatatggaacttgccagattgacatctgaggattctgccatctattactgtgcaagagcggcctggtatatggactactggggtcaaggaacctcagtcaccgtctcctcagggggtggaggctctggtggcggtggctctggcggaggtggatccggtggcggcggatctgacattgtgctgtcacagtctccatcctccctggctgtgtcagcaggagagaaggtcactatgagctgcaaatccagtcagagtctgctcaacagtagaacccgagagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcacgcaatcttataatctttacacgttcggaggggggaccaagctggaaataaaataa

SEQ ID NO: 203 - protein, 720 aa, Artificial Sequence
  PDL1::3D1 fusion protein
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSQVQLQQSGPELVRPGESVKISCKGSGYTFTDYAIQWVKQSHAKSLEWIGVINIYYDNTNYNQKFKGKATMTVDKSSSTAYMELARLTSEDSAIYYCARAAWYMDYWGQGTSVTVSSGGGGSGGGGSGGGGSGGGGSDIVLSQSPSSLAVSAGEKVTMSCKSSQSLLNSRTRENYLAWYQQKPGQSPKLLIYWASTRESGVPDRFTGSGSGTDFTLTISSVQAEDLAVYYCTQSYNLYTFGGGTKLEIK

SEQ ID NO: 204 - DNA, 2106 bp, Artificial Sequence
  Nucleotide sequence encoding PDL2::3D1 fusion protein
ttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccttagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaactctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctcaggtccagctgcagcagtctgggcctgagctggtgaggcctggggaatcagtgaagatttcctgcaagggttccggctacacattcactgattatgctatacagtgggtgaagcagagtcatgcaaagagtctagagtggattggagttattaatatttactatgataatacaaactacaaccagaagtttaagggcaaggccacaatgactgtagacaaatcctccagcacagcctatatggaacttgccagattgacatctgaggattctgccatctattactgtgcaagagcggcctggtatatggactactggggtcaaggaacctcagtcaccgtctcctcagggggtggaggctctggtggcggtggctctggcggaggtggatccggtggcggcggatctgacattgtgctgtcacagtctccatcctccctggctgtgtcagcaggagagaaggtcactatgagctgcaaatccagtcagagtctgctcaacagtagaacccgagagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcacgcaatcttataatctttacacgttcggaggggggaccaagctggaaataaaataa

SEQ ID NO: 205 - protein, 701 aa, Artificial Sequence
  PDL2::3D1 fusion protein
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSQVQLQQSGPELVRPGESVKISCKGSGYTFTDYAIQWVKQSHAKSLEWIGVINIYYDNTNYNQKFKGKATMTVDKSSSTAYMELARLTSEDSAIYYCARAAWYMDYWGQGTSVTVSSGGGGSGGGGSGGGGSGGGGSDIVLSQSPSSLAVSAGEKVTMSCKSSQSLLNSRTRENYLAWYQQKPGQSPKLLIYWASTRESGVPDRFTGSGSGTDFTLTISSVQAEDLAVYYCTQSYNLYTFGGGTKLEIK

SEQ ID NO: 206 - DNA, 1806 bp, Artificial Sequence
  Nucleotide sequence encoding TGFBetaR1::3D1 fusion protein
gcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattccgcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctcaggtccagctgcagcagtctgggcctgagctggtgaggcctggggaatcagtgaagatttcctgcaagggttccggctacacattcactgattatgctatacagtgggtgaagcagagtcatgcaaagagtctagagtggattggagttattaatatttactatgataatacaaactacaaccagaagtttaagggcaaggccacaatgactgtagacaaatcctccagcacagcctatatggaacttgccagattgacatctgaggattctgccatctattactgtgcaagagcggcctggtatatggactactggggtcaaggaacctcagtcaccgtctcctcagggggtggaggctctggtggcggtggctctggcggaggtggatccggtggcggcggatctgacattgtgctgtcacagtctccatcctccctggctgtgtcagcaggagagaaggtcactatgagctgcaaatccagtcagagtctgctcaacagtagaacccgagagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcacgcaatcttataatctttacacgttcggaggggggaccaagctggaaataaaataa

SEQ ID NO: 207 - protein, 601 aa, Artificial Sequence
  TGFBetaR1::3D1 fusion protein
AALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSQVQLQQSGPELVRPGESVKISCKGSGYTFTDYAIQWVKQSHAKSLEWIGVINIYYDNTNYNQKFKGKATMTVDKSSSTAYMELARLTSEDSAIYYCARAAWYMDYWGQGTSVTVSSGGGGSGGGGSGGGGSGGGGSDIVLSQSPSSLAVSAGEKVTMSCKSSQSLLNSRTRENYLAWYQQKPGQSPKLLIYWASTRESGVPDRFTGSGSGTDFTLTISSVQAEDLAVYYCTQSYNLYTFGGGTKLEIK

SEQ ID NO: 208 - DNA, 1629 bp, Artificial Sequence
  Nucleotide sequence encoding CTLA4::monoIL10 I87A fusion protein
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacggtggtggatccggcggtaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 209 - protein, 542 aa, Artificial Sequence
  CTLA4::monoIL10 I87A fusion protein
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSSPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENGGGSGGKSKAVEQVKNAFNKLQEKGIYKAMSEFDIFINYIEAYMTMKIRN

SEQ ID NO: 210 - DNA, 2001 bp, Artificial Sequence
  Nucleotide sequence encoding monoIL10::3D1 fusion protein
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacggtggtggatccggcggtaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctcaggtccagctgcagcagtctgggcctgagctggtgaggcctggggaatcagtgaagatttcctgcaagggttccggctacacattcactgattatgctatacagtgggtgaagcagagtcatgcaaagagtctagagtggattggagttattaatatttactatgataatacaaactacaaccagaagtttaagggcaaggccacaatgactgtagacaaatcctccagcacagcctatatggaacttgccagattgacatctgaggattctgccatctattactgtgcaagagcggcctggtatatggactactggggtcaaggaacctcagtcaccgtctcctcagggggtggaggctctggtggcggtggctctggcggaggtggatccggtggcggcggatctgacattgtgctgtcacagtctccatcctccctggctgtgtcagcaggagagaaggtcactatgagctgcaaatccagtcagagtctgctcaacagtagaacccgagagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcacgcaatcttataatctttacacgttcggaggggggaccaagctggaaataaaataa

SEQ ID NO: 211 - protein, 666 aa, Artificial Sequence
  monoIL10::3D1 fusion protein
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSQVQLQQSGPELVRPGESVKISCKGSGYTFTDYAIQWVKQSHAKSLEWIGVINIYYDNTNYNQKFKGKATMTVDKSSSTAYMELARLTSEDSAIYYCARAAWYMDYWGQGTSVTVSSGGGGSGGGGSGGGGSGGGGSDIVLSQSPSSLAVSAGEKVTMSCKSSQSLLNSRTRENYLAWYQQKPGQSPKLLIYWASTRESGVPDRFTGSGSGTDFTLTISSVQAEDLAVYYCTQSYNLYTFGGGTKLEIK

SEQ ID NO: 212 - DNA, 1983 bp, Artificial Sequence
  Nucleotide sequence encoding IL10 I87A::3D1 fusion protein
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctcaggtccagctgcagcagtctgggcctgagctggtgaggcctggggaatcagtgaagatttcctgcaagggttccggctacacattcactgattatgctatacagtgggtgaagcagagtcatgcaaagagtctagagtggattggagttattaatatttactatgataatacaaactacaaccagaagtttaagggcaaggccacaatgactgtagacaaatcctccagcacagcctatatggaacttgccagattgacatctgaggattctgccatctattactgtgcaagagcggcctggtatatggactactggggtcaaggaacctcagtcaccgtctcctcagggggtggaggctctggtggcggtggctctggcggaggtggatccggtggcggcggatctgacattgtgctgtcacagtctccatcctccctggctgtgtcagcaggagagaaggtcactatgagctgcaaatccagtcagagtctgctcaacagtagaacccgagagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcacgcaatcttataatctttacacgttcggaggggggaccaagctggaaataaaataa

SEQ ID NO: 213 - protein, 660 aa, Artificial Sequence
  IL10 I87A::3D1 fusion protein
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSQVQLQQSGPELVRPGESVKISCKGSGYTFTDYAIQWVKQSHAKSLEWIGVINIYYDNTNYNQKFKGKATMTVDKSSSTAYMELARLTSEDSAIYYCARAAWYMDYWGQGTSVTVSSGGGGSGGGGSGGGGSGGGGSDIVLSQSPSSLAVSAGEKVTMSCKSSQSLLNSRTRENYLAWYQQKPGQSPKLLIYWASTRESGVPDRFTGSGSGTDFTLTISSVQAEDLAVYYCTQSYNLYTFGGGTKLEIK

SEQ ID NO: 214 - DNA, 2001 bp, Artificial Sequence
  Nucleotide sequence encoding monoIL10 I87A::3D1 fusion protein
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacggtggtggatccggcggtaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctcaggtccagctgcagcagtctgggcctgagctggtgaggcctggggaatcagtgaagatttcctgcaagggttccggctacacattcactgattatgctatacagtgggtgaagcagagtcatgcaaagagtctagagtggattggagttattaatatttactatgataatacaaactacaaccagaagtttaagggcaaggccacaatgactgtagacaaatcctccagcacagcctatatggaacttgccagattgacatctgaggattctgccatctattactgtgcaagagcggcctggtatatggactactggggtcaaggaacctcagtcaccgtctcctcagggggtggaggctctggtggcggtggctctggcggaggtggatccggtggcggcggatctgacattgtgctgtcacagtctccatcctccctggctgtgtcagcaggagagaaggtcactatgagctgcaaatccagtcagagtctgctcaacagtagaacccgagagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcacgcaatcttataatctttacacgttcggaggggggaccaagctggaaataaaataa

SEQ ID NO: 215 - protein, 666 aa, Artificial Sequence
  monoIL10 I87A::3D1 fusion protein
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENGGGSGGKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSQVQLQQSGPELVRPGESVKISCKGSGYTFTDYAIQWVKQSHAKSLEWIGVINIYYDNTNYNQKFKGKATMTVDKSSSTAYMELARLTSEDSAIYYCARAAWYMDYWGQGTSVTVSSGGGGSGGGGSGGGGSGGGGSDIVLSQSPSSLAVSAGEKVTMSCKSSQSLLNSRTRENYLAWYQQKPGQSPKLLIYWASTRESGVPDRFTGSGSGTDFTLTISSVQAEDLAVYYCTQSYNLYTFGGGTKLEIK

SEQ ID NO: 216 - DNA, 1071 bp, Artificial Sequence
  LEA29-Fc - a CTLA4 variant
atgcacgtggcccagcctgctgtggtactggccagcagccgaggcatcgccagctttgtgtgtgagtatgcatctccaggcaaatacactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacgagggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 217 - protein, 356 aa, Artificial Sequence
  LEA29-Fc - a CTLA4 variant
MHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 218 - DNA, 1614 bp, Artificial Sequence
  Nucleotide sequence encoding LEA29Y::IL10 fusion protein with H75 linker
atgcacgtggcccagcctgctgtggtactggccagcagccgaggcatcgccagctttgtgtgtgagtatgcatctccaggcaaatacactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacgagggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaggaactcagatggcaggtcattctccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 219 - protein, 537 aa, Artificial Sequence
  LEA29Y::IL10 fusion protein with H75 linker
MHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTGTQMAGHSPNSSPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYMTMKIRN

SEQ ID NO: 220 - DNA, 1602 bp, Artificial Sequence
  Nucleotide sequence encoding CTLA4::monoIL10 fusion protein with H79 linker
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacggtggtggatccggcggtaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 221 - protein, 533 aa, Artificial Sequence
  CTLA4::monoIL10 fusion protein with H79 linker
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 222 - DNA, 1608 bp, Artificial Sequence
  Nucleotide sequence encoding CTLA4::monoIL10 fusion protein with H80 linker
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacggtggtggatccggcggtaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 223 - protein, 535 aa, Artificial Sequence [sequence omitted]

SEQ ID NO: 224 - DNA, 1473 bp, Artificial Sequence
  Humanized FUN1 SMIP M0114 - a generated variant of humanized FUN1
gaggtccagctggtacagtctggggctgaggtgaagaagcctggggctacagtgaaaatctcctgcaaggtttctggatacaccttcaccgactacaacatgaactgggtgcaacaggcccctggaaaagggcttgagtggatgggaaatattgatccttactatggtggtactagttacaatcagaagttcaagggcagagtcaccataaccgcggacacgtctacagacacagcctacatggagctgagcagcctgagatctgaggacacggccgtgtattactgtgcaacatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 225 - protein, 490 aa, Artificial Sequence
  Humanized FUN1 SMIP M0114 - a generated variant of humanized FUN1
EVQLVQSGAEVKKPGATVKISCKVSGYTFTDYNMNWVQQAPGKGLEWMGNIDPYYGGTSYNQKFKGRVTITADTSTDTAYMELSSLRSEDTAVYYCATWDYRYDDGRAYYVMDFWGQGTTVTVSSGGGGSGGGGSGGGGSGGGGSDIVMTQSPDSLAVSLGERATINCKSSQSVLYSSNQKNYLAWYQQKPGQPPKLLIYWASTRESGVPDRFSGSGSGTDFTLTISSLQAEDVAVYYCHQYLYSWTFGQGTKLEIKRLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 226 - DNA, 1473 bp, Artificial Sequence
  Humanized FUN1 SMIP M0115 - a generated variant of humanized FUN1
caggtgcagctggtgcagtctggggctgaggtgaagaagcctggggcctcagtgaaggtctcctgcaaggcttctggatacaccttcaccgactacaacatgaactgggtgcgacaggcccctggacaagggcttgagtggatgggaaatattgatccttactatggtggtactagttacaatcagaagttcaagggcagggtcaccatgaccagggacacgtccatcagcacagcctacatggagctgagcaggctgagatctgacgacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 227 - protein, 490 aa, Artificial Sequence
  Humanized FUN1 SMIP M0115 - a generated variant of humanized FUN1
QVQLVQSGAEVKKPGASVKVSCKASGYTFTDYNMNWVRQAPGQGLEWMGNIDPYYGGTSYNQKFKGRVTMTRDTSISTAYMELSRLRSDDTAVYYCARWDYRYDDGRAYYVMDFWGQGTTVTVSSGGGGSGGGGSGGGGSGGGGSDIVMTQSPDSLAVSLGERATINCKSSQSVLYSSNQKNYLAWYQQKPGQPPKLLIYWASTRESGVPDRFSGSGSGTDFTLTISSLQAEDVAVYYCHQYLYSWTFGQGTKLEIKRLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 228 - DNA, 1473 bp, Artificial Sequence
  Humanized FUN1 SMIP M0116 - a generated variant of humanized FUN1
caggtgcagctggtggagtctgggggaggcttggtcaagcctggagggtccctgagactctcctgtgcagcctctggattcaccttcagtgactacaacatgaactggatacgccaggctccagggaaggggctggagtgggtttcaaatattgatccttactatggtggtactagttacaatcagaagttcaagggccgattcaccatctccagggacaacgccaagaactcactgtatctgcaaatgaacagcctgagagccgaggacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 229 - protein, 490 aa, Artificial Sequence
  Humanized FUN1 SMIP M0116 - a generated variant of humanized FUN1
QVQLVESGGGLVKPGGSLRLSCAASGFTFSDYNMNWIRQAPGKGLEWVSNIDPYYGGTSYNQKFKGRFTISRDNAKNSLYLQMNSLRAEDTAVYYCARWDYRYDDGRAYYVMDFWGQGTTVTVSSGGGGSGGGGSGGGGSGGGGSDIVMTQSPDSLAVSLGERATINCKSSQSVLYSSNQKNYLAWYQQKPGQPPKLLIYWASTRESGVPDRFSGSGSGTDFTLTISSLQAEDVAVYYCHQYLYSWTFGQGTKLEIKRLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 230 - DNA, 1473 bp, Artificial Sequence
  Humanized FUN1 SMIP M0117 - a generated variant of humanized FUN1
gaggtccagctggtacagtctggggctgaggtgaagaagcctggggctacagtgaaaatctcctgcaaggtttctggatacaccttcaccgactacaacatgaactgggtgcaacaggcccctggaaaagggcttgagtggatgggaaatattgatccttactatggtggtactagttacaatcagaagttcaagggcagagtcaccataaccgcggacacgtctacagacacagcctacatggagctgagcagcctgagatctgaggacacggccgtgtattactgtgcaacatgggactataggtacgacgacgggagggcttactatgttatggacttctggggccaagggaccacggtcaccgtctcctcaggtggaggcggttcaggcggaggtggatccggcggtggcggatcgggtggcggcggatctgacatccagatgacccagtctccatcctccctgtctgcatctgtaggagacagagtcaccatcacttgcaagtccagccagagtgttttatacagctccaaccagaagaactacttagcttggtatcagcagaaaccagggaaagttcctaagctcctgatctattgggcatccactagggaatctggggtcccatctcggttcagtggcagtggatctgggacagatttcactctcaccatcagcagcctgcagcctgaagatgttgcaacttattactgtcatcaatacctctactcgtggacgtttggccaggggaccaagctggagatcaaacggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 231 - protein, 490 aa, Artificial Sequence
  Humanized FUN1 SMIP M0117 - a generated variant of humanized FUN1
EVQLVQSGAEVKKPGATVKISCKVSGYTFTDYNMNWVQQAPGKGLEWMGNIDPYYGGTSYNQKFKGRVTITADTSTDTAYMELSSLRSEDTAVYYCATWDYRYDDGRAYYVMDFWGQGTTVTVSSGGGGSGGGGSGGGGSGGGGSDIQMTQSPSSLSASVGDRVTITCKSSQSVLYSSNQKNYLAWYQQKPGKVPKLLIYWASTRESGVPSRFSGSGSGTDFTLTISSLQPEDVATYYCHQYLYSWTFGQGTKLEIKRLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 232 - DNA, 1473 bp, Artificial Sequence
  Humanized FUN1 SMIP M0118 - a generated variant of humanized FUN1
caggtgcagctggtgcagtctggggctgaggtgaagaagcctggggcctcagtgaaggtctcctgcaaggcttctggatacaccttcaccgactacaacatgaactgggtgcgacaggcccctggacaagggcttgagtggatgggaaatattgatccttactatggtggtactagttacaatcagaagttcaagggcagggtcaccatgaccagggacacgtccatcagcacagcctacatggagctgagcaggctgagatctgacgacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatccagatgacccagtctccatcctccctgtctgcatctgtaggagacagagtcaccatcacttgcaagtccagccagagtgttttatacagctccaaccagaagaactacttagcttggtatcagcagaaaccagggaaagttcctaagctcctgatctattgggcatccactagggaatctggggtcccatctcggttcagtggcagtggatctgggacagatttcactctcaccatcagcagcctgcagcctgaagatgttgcaacttattactgtcatcaatacctctactcgtggacgtttggccaggggaccaagctggagatcaaacggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 233 - protein, 490 aa, Artificial Sequence
  Humanized FUN1 SMIP M0118 - a generated variant of humanized FUN1
QVQLVQSGAEVKKPGASVKVSCKASGYTFTDYNMNWVRQAPGQGLEWMGNIDPYYGGTSYNQKFKGRVTMTRDTSISTAYMELSRLRSDDTAVYYCARWDYRYDDGRAYYVMDFWGQGTTVTVSSGGGGSGGGGSGGGGSGGGGSDIQMTQSPSSLSASVGDRVTITCKSSQSVLYSSNQKNYLAWYQQKPGKVPKLLIYWASTRESGVPSRFSGSGSGTDFTLTISSLQPEDVATYYCHQYLYSWTFGQGTKLEIKRLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 234 - DNA, 1473 bp, Artificial Sequence
  Humanized FUN1 SMIP M0119 - a generated variant of humanized FUN1
caggtgcagctggtggagtctgggggaggcttggtcaagcctggagggtccctgagactctcctgtgcagcctctggattcaccttcagtgactacaacatgaactggatacgccaggctccagggaaggggctggagtgggtttcaaatattgatccttactatggtggtactagttacaatcagaagttcaagggccgattcaccatctccagggacaacgccaagaactcactgtatctgcaaatgaacagcctgagagccgaggacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatccagatgacccagtctccatcctccctgtctgcatctgtaggagacagagtcaccatcacttgcaagtccagccagagtgttttatacagctccaaccagaagaactacttagcttggtatcagcagaaaccagggaaagttcctaagctcctgatctattgggcatccactagggaatctggggtcccatctcggttcagtggcagtggatctgggacagatttcactctcaccatcagcagcctgcagcctgaagatgttgcaacttattactgtcatcaatacctctactcgtggacgtttggccaggggaccaagctggagatcaaacggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 235 - protein, 490 aa, Artificial Sequence
  Humanized FUN1 SMIP M0119 - a generated variant of humanized FUN1
QVQLVESGGGLVKPGGSLRLSCAASGFTFSDYNMNWIRQAPGKGLEWVSNIDPYYGGTSYNQKFKGRFTISRDNAKNSLYLQMNSLRAEDTAVYYCARWDYRYDDGRAYYVMDFWGQGTTVTVSSGGGGSGGGGSGGGGSGGGGSDIQMTQSPSSLSASVGDRVTITCKSSQSVLYSSNQKNYLAWYQQKPGKVPKLLIYWASTRESGVPSRFSGSGSGTDFTLTISSLQPEDVATYYCHQYLYSWTFGQGTKLEIKRLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 236 - DNA, 2013 bp, Artificial Sequence
  Nucleotide sequence encoding humanized FUN1 M0115::IL10 fusion protein
caggtgcagctggtgcagtctggggctgaggtgaagaagcctggggcctcagtgaaggtctcctgcaaggcttctggatacaccttcaccgactacaacatgaactgggtgcgacaggcccctggacaagggcttgagtggatgggaaatattgatccttactatggtggtactagttacaatcagaagttcaagggcagggtcaccatgaccagggacacgtccatcagcacagcctacatggagctgagcaggctgagatctgacgacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 237 - protein, 670 aa, Artificial Sequence
  humanized FUN1 M0115::IL10 fusion protein
QVQLVQSGAEVKKPGASVKVSCKASGYTFTDYNMNWVRQAPGQGLEWMGNIDPYYGGTSYNQKFKGRVTMTRDTSISTAYMELSRLRSDDTAVYYCARWDYRYDDGRAYYVMDFWGQGTTVTVSSGGGGSGGGGSGGGGSGGGGSDIVMTQSPDSLAVSLGERATINCKSSQSVLYSSNQKNYLAWYQQKPGQPPKLLIYWASTRESGVPDRFSGSGSGTDFTLTISSLQAEDVAVYYCHQYLYSWTFGQGTKLEIKRLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 238 - DNA, 1443 bp, Artificial Sequence
  anti-mouse CD86 (GL1) SMIP
gaggtgcagctggtggagtctgctggaggtttagtgcagcctggaaggtccctaaaactctcctgtgcagcctcaggattcactttcagtgactattacatggcctgggtccgccaggctccaacgaaggggctggagtgggtcgcaaccattagtcatgacggtagtagtacttactatcgagactccgtgaagggccgattcacaatctccagagataatgcaaaaaccatcctatacctgcaaatggacagtctgaggtctgaggacacggccacttatttctgtgcaagacagaatattatggattattggggccaaggagtcatggtcacagtctcctcagggggtggaggctctggtggcggtggctctggcggaggtggatccggtggcggcggatctgacattgtgatgacccagactccatcctcccaggctgtgtcagcaggggagaaggtcactatgagctgcaagtccagtcagagtcttttgtacagtagagaccagagtaactacttggcctggtaccagcagaaacctgggcagtctcctaaactacttatctacttggcatccactagggaatcaggggtccctgatcgcttcataggcagtggctctgggacagacttcactctgaccatcagcagtgtgcaggctgaagatctggcagattattactgtcagcagcattacaactatccgctcacgttcggttctgggaccaagctagaaatcaaactcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 239 - protein, 480 aa, Artificial Sequence
  anti-mouse CD86 (GL1) SMIP
EVQLVESAGGLVQPGRSLKLSCAASGFTFSDYYMAWVRQAPTKGLEWVATISHDGSSTYYRDSVKGRFTISRDNAKTILYLQMDSLRSEDTATYFCARQNIMDYWGQGVMVTVSSGGGGSGGGGSGGGGSGGGGSDIVMTQTPSSQAVSAGEKVTMSCKSSQSLLYSRDQSNYLAWYQQKPGQSPKLLIYLASTRESGVPDRFIGSGSGTDFTLTISSVQAEDLADYYCQQHYNYPLTFGSGTKLEIKLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 240 - DNA, 345 bp, Artificial Sequence
  Nucleotide sequence encoding anti-mouse CD86 (GL1) heavy chain
gaggtgcagctggtggagtctgctggaggtttagtgcagcctggaaggtccctaaaactctcctgtgcagcctcaggattcactttcagtgactattacatggcctgggtccgccaggctccaacgaaggggctggagtgggtcgcaaccattagtcatgacggtagtagtacttactatcgagactccgtgaagggccgattcacaatctccagagataatgcaaaaaccatcctatacctgcaaatggacagtctgaggtctgaggacacggccacttatttctgtgcaagacagaatattatggattattggggccaaggagtcatggtcacagtctcctca

SEQ ID NO: 241 - protein, 115 aa, Artificial Sequence
  Anti-mouse CD86 (GL1) heavy chain
EVQLVESAGGLVQPGRSLKLSCAASGFTFSDYYMAWVRQAPTKGLEWVATISHDGSSTYYRDSVKGRFTISRDNAKTILYLQMDSLRSEDTATYFCARQNIMDYWGQGVMVTVSS

SEQ ID NO: 242 - DNA, 339 bp, Artificial Sequence
  Nucleotide sequence encoding Anti-mouse CD86 (GL1) light chain
gacattgtgatgacccagactccatcctcccaggctgtgtcagcaggggagaaggtcactatgagctgcaagtccagtcagagtcttttgtacagtagagaccagagtaactacttggcctggtaccagcagaaacctgggcagtctcctaaactacttatctacttggcatccactagggaatcaggggtccctgatcgcttcataggcagtggctctgggacagacttcactctgaccatcagcagtgtgcaggctgaagatctggcagattattactgtcagcagcattacaactatccgctcacgttcggttctgggaccaagctagaaatcaaa

SEQ ID NO: 243 - protein, 113 aa, Artificial Sequence
  Anti-mouse CD86 (GL1) light chain
DIVMTQTPSSQAVSAGEKVTMSCKSSQSLLYSRDQSNYLAWYQQKPGQSPKLLIYLASTRESGVPDRFIGSGSGTDFTLTISSVQAEDLADYYCQQHYNYPLTFGSGTKLEIK

SEQ ID NO: 244 - protein, 20 aa, Artificial Sequence
  Anti-mouse CD86 (GL1) scFv linker
GGGGSGGGGSGGGGSGGGGS

SEQ ID NO: 245 - protein, 5 aa, Artificial Sequence
  Anti-mouse CD86 (GL1) HCDR1
DYYMA

SEQ ID NO: 246 - protein, 17 aa, Artificial Sequence
  Anti-mouse CD86 (GL1) HCDR2
TISHDGSSTYYRDSVKG

SEQ ID NO: 247 - protein, 6 aa, Artificial Sequence
  Anti-mouse CD86 (GL1) HCDR3
QNIMDY

SEQ ID NO: 248 - protein, 17 aa, Artificial Sequence
  Anti-mouse CD86 (GL1) LCDR1
KSSQSLLYSRDQSNYLA

SEQ ID NO: 249 - protein, 7 aa, Artificial Sequence
  Anti-mouse CD86 (GL1) LCDR2
LASTRES

SEQ ID NO: 250 - protein, 9 aa, Artificial Sequence
  Anti-mouse CD86 (GL1) LCDR3
QQHYNYPLT

SEQ ID NO: 251 - DNA, 1983 bp, Artificial Sequence
  Nucleotide sequence encoding mouse anti-CD86::IL10 fusion protein
gaggtgcagctggtggagtctgctggaggtttagtgcagcctggaaggtccctaaaactctcctgtgcagcctcaggattcactttcagtgactattacatggcctgggtccgccaggctccaacgaaggggctggagtgggtcgcaaccattagtcatgacggtagtagtacttactatcgagactccgtgaagggccgattcacaatctccagagataatgcaaaaaccatcctatacctgcaaatggacagtctgaggtctgaggacacggccacttatttctgtgcaagacagaatattatggattattggggccaaggagtcatggtcacagtctcctcagggggtggaggctctggtggcggtggctctggcggaggtggatccggtggcggcggatctgacattgtgatgacccagactccatcctcccaggctgtgtcagcaggggagaaggtcactatgagctgcaagtccagtcagagtcttttgtacagtagagaccagagtaactacttggcctggtaccagcagaaacctgggcagtctcctaaactacttatctacttggcatccactagggaatcaggggtccctgatcgcttcataggcagtggctctgggacagacttcactctgaccatcagcagtgtgcaggctgaagatctggcagattattactgtcagcagcattacaactatccgctcacgttcggttctgggaccaagctagaaatcaaactcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 252 - protein, 660 aa, Artificial Sequence
  mouse anti-CD86::IL10 fusion protein
EVQLVESAGGLVQPGRSLKLSCAASGFTFSDYYMAWVRQAPTKGLEWVATISHDGSSTYYRDSVKGRFTISRDNAKTILYLQMDSLRSEDTATYFCARQNIMDYWGQGVMVTVSSGGGGSGGGGSGGGGSGGGGSDIVMTQTPSSQAVSAGEKVTMSCKSSQSLLYSRDQSNYLAWYQQKPGQSPKLLIYLASTRESGVPDRFIGSGSGTDFTLTISSVQAEDLADYYCQQHYNYPLTFGSGTKLEIKLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 253 - DNA, 2013 bp, Artificial Sequence
  Nucleotide sequence encoding IL10::humanized Fun1 M0115 fusion protein
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctcaggtgcagctggtgcagtctggggctgaggtgaagaagcctggggcctcagtgaaggtctcctgcaaggcttctggatacaccttcaccgactacaacatgaactgggtgcgacaggcccctggacaagggcttgagtggatgggaaatattgatccttactatggtggtactagttacaatcagaagttcaagggcagggtcaccatgaccagggacacgtccatcagcacagcctacatggagctgagcaggctgagatctgacgacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggtaa

SEQ ID NO: 254 - protein, 670 aa, Artificial Sequence
  IL10::humanized Fun1 M0115 fusion protein
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSQVQLVQSGAEVKKPGASVKVSCKASGYTFTDYNMNWVRQAPGQGLEWMGNIDPYYGGTSYNQKFKGRVTMTRDTSISTAYMELSRLRSDDTAVYYCARWDYRYDDGRAYYVMDFWGQGTTVTVSSGGGGSGGGGSGGGGSGGGGSDIVMTQSPDSLAVSLGERATINCKSSQSVLYSSNQKNYLAWYQQKPGQPPKLLIYWASTRESGVPDRFSGSGSGTDFTLTISSLQAEDVAVYYCHQYLYSWTFGQGTKLEIKR

SEQ ID NO: 255 - DNA, 1983 bp, Artificial Sequence
  Nucleotide sequence encoding IL10::anti-mouse CD86 fusion protein
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctgaggtgcagctggtggagtctgctggaggtttagtgcagcctggaaggtccctaaaactctcctgtgcagcctcaggattcactttcagtgactattacatggcctgggtccgccaggctccaacgaaggggctggagtgggtcgcaaccattagtcatgacggtagtagtacttactatcgagactccgtgaagggccgattcacaatctccagagataatgcaaaaaccatcctatacctgcaaatggacagtctgaggtctgaggacacggccacttatttctgtgcaagacagaatattatggattattggggccaaggagtcatggtcacagtctcctcagggggtggaggctctggtggcggtggctctggcggaggtggatccggtggcggcggatctgacattgtgatgacccagactccatcctcccaggctgtgtcagcaggggagaaggtcactatgagctgcaagtccagtcagagtcttttgtacagtagagaccagagtaactacttggcctggtaccagcagaaacctgggcagtctcctaaactacttatctacttggcatccactagggaatcaggggtccctgatcgcttcataggcagtggctctgggacagacttcactctgaccatcagcagtgtgcaggctgaagatctggcagattattactgtcagcagcattacaactatccgctcacgttcggttctgggaccaagctagaaatcaaataa

SEQ ID NO: 256 - protein, 660 aa, Artificial Sequence
  IL10::anti-mouse CD86 fusion protein
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSEVQLVESAGGLVQPGRSLKLSCAASGFTFSDYYMAWVRQAPTKGLEWVATISHDGSSTYYRDSVKGRFTISRDNAKTILYLQMDSLRSEDTATYFCARQNIMDYWGQGVMVTVSSGGGGSGGGGSGGGGSGGGGSDIVMTQTPSSQAVSAGEKVTMSCKSSQSLLYSRDQSNYLAWYQQKPGQSPKLLIYLASTRESGVPDRFIGSGSGTDFTLTISSVQAEDLADYYCQQHYNYPLTFGSGTKLEIK

SEQ ID NO: 257 - DNA, 2016 bp, Artificial Sequence
  Nucleotide sequence encoding IL10 I87A::humanized Fun1 M0115 fusion protein with H75 linker
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaggaactcagatggcaggtcattctccgaattctcaggtgcagctggtgcagtctggggctgaggtgaagaagcctggggcctcagtgaaggtctcctgcaaggcttctggatacaccttcaccgactacaacatgaactgggtgcgacaggcccctggacaagggcttgagtggatgggaaatattgatccttactatggtggtactagttacaatcagaagttcaagggcagggtcaccatgaccagggacacgtccatcagcacagcctacatggagctgagcaggctgagatctgacgacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggtaa

SEQ ID NO: 258 - protein, 671 aa, Artificial Sequence
  IL10 I87A::humanized Fun1 M0115 fusion protein with H75 linker
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTGTQMAGHSPNSQVQLVQSGAEVKKPGASVKVSCKASGYTFTDYNMNWVRQAPGQGLEWMGNIDPYYGGTSYNQKFKGRVTMTRDTSISTAYMELSRLRSDDTAVYYCARWDYRYDDGRAYYVMDFWGQGTTVTVSSGGGGSGGGGSGGGGSGGGGSDIVMTQSPDSLAVSLGERATINCKSSQSVLYSSNQKNYLAWYQQKPGQPPKLLIYWASTRESGVPDRFSGSGSGTDFTLTISSLQAEDVAVYYCHQYLYSWTFGQGTKLEIKR

SEQ ID NO: 259 - DNA, 1986 bp, Artificial Sequence
  Nucleotide sequence encoding IL10 I87A::anti-mouse CD86 fusion protein with H75 linker
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaggaactcagatggcaggtcattctccgaattctgaggtgcagctggtggagtctgctggaggtttagtgcagcctggaaggtccctaaaactctcctgtgcagcctcaggattcactttcagtgactattacatggcctgggtccgccaggctccaacgaaggggctggagtgggtcgcaaccattagtcatgacggtagtagtacttactatcgagactccgtgaagggccgattcacaatctccagagataatgcaaaaaccatcctatacctgcaaatggacagtctgaggtctgaggacacggccacttatttctgtgcaagacagaatattatggattattggggccaaggagtcatggtcacagtctcctcagggggtggaggctctggtggcggtggctctggcggaggtggatccggtggcggcggatctgacattgtgatgacccagactccatcctcccaggctgtgtcagcaggggagaaggtcactatgagctgcaagtccagtcagagtcttttgtacagtagagaccagagtaactacttggcctggtaccagcagaaacctgggcagtctcctaaactacttatctacttggcatccactagggaatcaggggtccctgatcgcttcataggcagtggctctgggacagacttcactctgaccatcagcagtgtgcaggctgaagatctggcagattattactgtcagcagcattacaactatccgctcacgttcggttctgggaccaagctagaaatcaaataa

SEQ ID NO: 260 - protein, 661 aa, Artificial Sequence
  IL10 I87A::anti-mouse CD86 fusion protein with H75 linker
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTGTQMAGHSPNSEVQLVESAGGLVQPGRSLKLSCAASGFTFSDYYMAWVRQAPTKGLEWVATISHDGSSTYYRDSVKGRFTISRDNAKTILYLQMDSLRSEDTATYFCARQNIMDYWGQGVMVTVSSGGGGSGGGGSGGGGSGGGGSDIVMTQTPSSQAVSAGEKVTMSCKSSQSLLYSRDQSNYLAWYQQKPGQSPKLLIYLASTRESGVPDRFIGSGSGTDFTLTISSVQAEDLADYYCQQHYNYPLTFGSGTKLEIK

SEQ ID NO: 261 - DNA, 1614 bp, Artificial Sequence
  Nucleotide sequence encoding CTLA4::IL10 I87A fusion protein with H75 linker
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaggaactcagatggcaggtcattctccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 262 - protein, 537 aa, Artificial Sequence
  CTLA4::IL10 I87A fusion protein with H75 linker
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTGTQMAGHSPNSSPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYMTMKIRN

SEQ ID NO: 263 - DNA, 1380 bp, Artificial Sequence
  Lymphotoxin beta receptor (LTBetaR) - Ig synthesized molecule
atgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaactcctacaacgagcactggaactacctgaccatctgccagctgtgccgcccctgtgacccagtgatgggcctagaggagattgccccctgcacaagcaaacggaagacccagtgccgctgccagccgggaatgttctgtgctgcctgggccctagagtgcacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 264 - protein, 459 aa, Artificial Sequence
  Lymphotoxin beta receptor (LTBetaR) - Ig synthesized molecule
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 265 - DNA, 2217 bp, Artificial Sequence
  Nucleotide sequence encoding LTBetaR::M0115 fusion protein
atgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaactcctacaacgagcactggaactacctgaccatctgccagctgtgccgcccctgtgacccagtgatgggcctagaggagattgccccctgcacaagcaaacggaagacccagtgccgctgccagccgggaatgttctgtgctgcctgggccctagagtgcacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaggaactcagatggcaggtcattctccgaattctcaggtgcagctggtgcagtctggggctgaggtgaagaagcctggggcctcagtgaaggtctcctgcaaggcttctggatacaccttcaccgactacaacatgaactgggtgcgacaggcccctggacaagggcttgagtggatgggaaatattgatccttactatggtggtactagttacaatcagaagttcaagggcagggtcaccatgaccagggacacgtccatcagcacagcctacatggagctgagcaggctgagatctgacgacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggtaa

SEQ ID NO: 266 - protein, 738 aa, Artificial Sequence [sequence omitted]

SEQ ID NO: 267 - DNA, 1359 bp, Artificial Sequence
  PDL1 Ig synthesized molecule
tttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 268 - protein, 452 aa, Artificial Sequence
  PDL1 Ig synthesized molecule
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 269 - DNA, 1302 bp, Artificial Sequence
  PDL2 Ig synthesized molecule
ttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccttagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaactctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 270 - protein, 433 aa, Artificial Sequence
  PDL2 Ig synthesized molecule
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 271 - DNA, 534 bp, Artificial Sequence
  (GITR-L)-AFH synthesized molecule
tctggtagccatcatcatcatcatcacctgaacgacatcttcgaggctcagaaaatcgaatggcacgaagattacaaggatgacgacgataaggattacaaggatgacgacgataaggattacaaggatgacgacgataagctcgagcaattagagactgctaaggagccctgtatggctaagtttggaccattaccctcaaaatggcaaatggcatcttctgaacctccttgcgtgaataaggtgtctgactggaagctggagatacttcagaatggcttatatttaatttatggccaagtggctcccaatgcaaactacaatgatgtagctccttttgaggtgcggctgtataaaaacaaagacatgatacaaactctaacaaacaaatctaaaatccaaaatgtaggagggacttatgaattgcatgttggggacaccatagacttgatattcaactctgagcatcaggttctaaaaaataatacatactggggtatcattttactagcaaatccccaattcatctcctaa

SEQ ID NO: 272 - protein, 177 aa, Artificial Sequence
  (GITR-L)-AFH synthesized molecule
SGSHHHHHHLNDIFEAQKIEWHEDYKDDDDKDYKDDDDKDYKDDDDKLEQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 273 - DNA, 1281 bp, Artificial Sequence
  mIg LIGHT synthesized molecule
agctcccccagagtgcccataacacagaacccctgtcctccactcaaagagtgtcccccatgcgcagctccagacgcagcgggtgcgccatccgtcttcatcttccctccaaagatcaaggatgtactcatgatctccctgagccccatggtcacatgtgtggtggtggatgtgagcgaggatgacccagacgtccagatcagctggtttgtgaacaacgtggaagtacacacagctcagacacaaacccatagagaggattacaacagtactctccgggtggtcagtgccctccccatccagcaccaggactggatgagtggcaaggcgttcgcatgcgcggtcaacaacagagccctcccatcccccatcgagaaaaccatctcaaaacccagagggccagtaagagctccacaggtatatgtcttgcctccaccagcagaagagatgactaagaaagagttcagtctgacctgcatgatcacaggcttcttacctgccgaaattgctgtggactggaccagcaatgggcgtacagagcaaaactacaagaacaccgcaacagtcctggactctgatggttcttacttcatgtacagcaagctcagagtacaaaagagcacttgggaaagaggaagtcttttcgcctgctcagtggtccacgagggtctgcacaatcaccttacgactaagaccatctcccggtctctgggtaaaaactcattattcaaccaagaagttcaaattcccttgaccgaaagttacagcccgaattctgacggacctgcaggctcctgggagcagctgatacaagagcgaaggtctcacgaggtcaacccagcagcgcatctcacaggggccaactccagcttgaccggcagcggggggccgctgttatgggagactcagctgggcctggccttcctgaggggcctcagctaccacgatggggcccttgtggtcaccaaagctggctactactacatctactccaaggtgcagctgggcggtgtgggctgcccgctgggcctggccagcaccatcacccacggcctctacaagcgcacaccccgctaccccgaggagctggagctgttggtcagccagcagtcaccctgcggacgggccaccagcagctcccgggtctggtgggacagcagcttcctgggtggtgtggtacacctggaggctggggagaaggtggtcgtccgtgtgctggatgaacgcctggttcgactgcgtgatggtacccggtcttacttcggggctttcatggtgtag

SEQ ID NO: 274 - protein, 426 aa, Artificial Sequence
  mIg LIGHT synthesized molecule
SSPRVPITQNPCPPLKECPPCAAPDAAGAPSVFIFPPKIKDVLMISLSPMVTCVVVDVSEDDPDVQISWFVNNVEVHTAQTQTHREDYNSTLRVVSALPIQHQDWMSGKAFACAVNNRALPSPIEKTISKPRGPVRAPQVYVLPPPAEEMTKKEFSLTCMITGFLPAEIAVDWTSNGRTEQNYKNTATVLDSDGSYFMYSKLRVQKSTWERGSLFACSVVHEGLHNHLTTKTISRSLGKNSLFNQEVQIPLTESYSPNSDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 275 - DNA, 2022 bp, Artificial Sequence
  Nucleotide sequence encoding monoIL10-A2 hinge::M0115 fusion protein with H75 linker
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacggtggtggatccggcggtaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccccacctcccccatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaggaactcagatggcaggtcattctccgaattctcaggtgcagctggtgcagtctggggctgaggtgaagaagcctggggcctcagtgaaggtctcctgcaaggcttctggatacaccttcaccgactacaacatgaactgggtgcgacaggcccctggacaagggcttgagtggatgggaaatattgatccttactatggtggtactagttacaatcagaagttcaagggcagggtcaccatgaccagggacacgtccatcagcacagcctacatggagctgagcaggctgagatctgacgacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggtaa

SEQ ID NO: 276 - protein, 673 aa, Artificial Sequence
  monoIL10-A2 hinge::M0115 fusion protein with H75 linker
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYITMKIRNLEPPPPPCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTGTQMAGHSPNSQVQLVQSGAEVKKPGASVKVSCKASGYTFTDYNMNWVRQAPGQGLEWMGNIDPYYGGTSYNQKFKGRVTMTRDTSISTAYMELSRLRSDDTAVYYCARWDYRYDDGRAYYVMDFWGQGTTVTVSSGGGGSGGGGSGGGGSGGGGSDIVMTQSPDSLAVSLGERATINCKSSQSVLYSSNQKNYLAWYQQKPGQPPKLLIYWASTRESGVPDRFSGSGSGTDFTLTISSLQAEDVAVYYCHQYLYSWTFGQGTKLEIKR

SEQ ID NO: 277 - DNA, 1185 bp, Artificial Sequence
  HVEM Ig synthesized molecule
ctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 278 - protein, 394 aa, Artificial Sequence
  HVEM Ig synthesized molecule
LPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 279 - DNA, 1179 bp, Artificial Sequence
  IL10-Fc synthesized molecule
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 280 - protein, 392 aa, Artificial Sequence
  IL10-Fc synthesized molecule
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 281 - DNA, 1179 bp, Artificial Sequence
  IL10 I87A-Fc synthesized molecule
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 282 - protein, 392 aa, Artificial Sequence
  IL10 I87A-Fc synthesized molecule
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 283 - DNA, 1197 bp, Artificial Sequence
  monoIL10-Fc synthesized molecule
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacggtggtggatccggcggtaagagcaaggccgtggagcaggtgaagaatgcctttaataagctccaagagaaaggcatctacaaagccatgagtgagtttgacatcttcatcaactacatagaagcctacatgacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 284 - protein, 398 aa, Artificial Sequence
  monoIL10-Fc synthesized molecule
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 285 - DNA, 1197 bp, Artificial Sequence
  monoIL10 I87A-Fc synthesized molecule
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacggtggtggatccggcggtaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 286 - protein, 398 aa, Artificial Sequence
  monoIL10 I87A-Fc synthesized molecule
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENGGGSGGKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 287 - DNA, 1239 bp, Artificial Sequence
  Fc-IL10 synthesized molecule
gagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 288 - protein, 412 aa, Artificial Sequence
  Fc-IL10 synthesized molecule
EPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 289 - DNA, 1236 bp, Artificial Sequence
  Fc-IL10 I87A synthesized molecule
gagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 290 - protein, 411 aa, Artificial Sequence
  Fc-IL10 I87A synthesized molecule
EPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSSPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYMTMKIRN

SEQ ID NO: 291 - DNA, 1254 bp, Artificial Sequence
  Fc-monoIL10 synthesized molecule
gagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacggtggtggatccggcggtaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 292 - protein, 417 aa, Artificial Sequence
  Fc-monoIL10 synthesized molecule
EPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 293 - DNA, 1254 bp, Artificial Sequence
  Fc-monoIL10 I87A synthesized molecule
gagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacggtggtggatccggcggtaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 294 - protein, 417 aa, Artificial Sequence
  Fc-monoIL10 I87A synthesized molecule
EPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSSPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENGGGSGGKSKAVEQVKNAFNKLQEKGIYKAMSEFDIFINYIEAYMTMKIRN

SEQ ID NO: 295 - DNA, 1200 bp, Artificial Sequence
  mouse IL10-mouse null Fc synthesized molecule
agcaggggccagtacagccgggaagacaataactgcacccacttcccagtcggccagagccacatgctcctagagctgcggactgccttcagccaggtgaagactttctttcaaacaaaggaccagctggacaacatactgctaaccgactccttaatgcaggactttaagggttacttgggttgccaagccttatcggaaatgatccagttttacctggtagaagtgatgccccaggcagagaagcatggcccagaaatcaaggagcatttgaattccctgggtgagaagctgaagaccctcaggatgcggctgaggcgctgtcatcgatttctcccctgtgaaaataagagcaaggcagtggagcaggtgaagagtgattttaataagctccaagaccaaggtgtctacaaggccatgaatgaatttgacatcttcatcaactgcatagaagcatacatgatgatcaaaatgaaaagcctcgagcccagagtgcccataacacagaacccctgtcctccactcaaagagtgtcccccatgcgcagctccagacgcagcgggtgcgccatccgtcttcatcttccctccaaagatcaaggatgtactcatgatctccctgagccccatggtcacatgtgtggtggtggatgtgagcgaggatgacccagacgtccagatcagctggtttgtgaacaacgtggaagtacacacagctcagacacaaacccatagagaggattacaacagtactctccgggtggtcagtgccctccccatccagcaccaggactggatgagtggcaaggcgttcgcatgcgcggtcaacaacagagccctcccatcccccatcgagaaaaccatctcaaaacccagagggccagtaagagctccacaggtatatgtcttgcctccaccagcagaagagatgactaagaaagagttcagtctgacctgcatgatcgcaggcttcttacctgccgaaattgctgtggactggaccagcaatgggcgtacagagcaaaactacaagaacaccgcaacagtcctggactctgatggttcttacttcatgtacagcaagctcagagtacaaaagagcacttgggaaagaggaagtcttttcgcctgctcagtggtccacgagggtctgcacaatcaccttacgactaagaccatctcccggtctctgggtaaataa

SEQ ID NO: 296 - protein, 399 aa, Artificial Sequence
  mouse IL10-mouse null Fc synthesized molecule
SRGQYSREDNNCTHFPVGQSHMLLELRTAFSQVKTFFQTKDQLDNILLTDSLMQDFKGYLGCQALSEMIQFYLVEVMPQAEKHGPEIKEHLNSLGEKLKTLRMRLRRCHRFLPCENKSKAVEQVKSDFNKLQDQGVYKAMNEFDIFINCIEAYMMIKMKSLEPRVPITQNPCPPLKECPPCAAPDAAGAPSVFIFPPKIKDVLMISLSPMVTCVVVDVSEDDPDVQISWFVNNVEVHTAQTQTHREDYNSTLRVVSALPIQHQDWMSGKAFACAVNNRALPSPIEKTISKPRGPVRAPQVYVLPPPAEEMTKKEFSLTCMIAGFLPAEIAVDWTSNGRTEQNYKNTATVLDSDGSYFMYSKLRVQKSTWERGSLFACSVVHEGLHNHLTTKTISRSLGK

SEQ ID NO: 297 - DNA, 1095 bp, Artificial Sequence
  mouse CTLA4-mouse null2 Fc synthesized molecule
gccatacaggtgacccaaccttcagtggtgttggctagcagccatggtgtcgccagctttccatgtgaatattcaccatcacacaacactgatgaggtccgggtgactgtgctgcggcagacaaatgaccaaatgactgaggtctgtgccacgacattcacagagaagaatacagtgggcttcctagattaccccttctgcagtggtacctttaatgaaagcagagtgaacctcaccatccaaggactgagagctgttgacacgggactgtacctctgcaaggtggaactcatgtacccaccgccatactttgtgggcatgggcaacgggacgcagatttatgtcattgatccagaaccatgcccggattctgacctcgagcccagagtgcccataacacagaacccctgtcctccactcaaagagtgtcccccatgcgcagctccagacgcagcgggtgcgccatccgtcttcatcttccctccaaagatcaaggatgtactcatgatctccctgagccccatggtcacatgtgtggtggtggatgtgagcgaggatgacccagacgtccagatcagctggtttgtgaacaacgtggaagtacacacagctcagacacaaacccatagagaggattacaacagtactctccgggtggtcagtgccctccccatccagcaccaggactggatgagtggcaaggcgttcgcatgcgcggtcaacaacagagccctcccatcccccatcgagaaaaccatctcaaaacccagagggccagtaagagctccacaggtatatgtcttgcctccaccagcagaagagatgactaagaaagagttcagtctgacctgcatgatcgcaggcttcttacctgccgaaattgctgtggactggaccagcaatgggcgtacagagcaaaactacaagaacaccgcaacagtcctggactctgatggttcttacttcatgtacagcaagctcagagtacaaaagagcacttgggaaagaggaagtcttttcgcctgctcagtggtccacgagggtctgcacaatcaccttacgactaagaccatctcccggtctctgggtaaataa

SEQ ID NO: 298 - protein, 364 aa, Artificial Sequence
  mouse CTLA4-mouse null2 Fc synthesized molecule
AIQVTQPSVVLASSHGVASFPCEYSPSHNTDEVRVTVLRQTNDQMTEVCATTFTEKNTVGFLDYPFCSGTFNESRVNLTIQGLRAVDTGLYLCKVELMYPPPYFVGMGNGTQIYVIDPEPCPDSDLEPRVPITQNPCPPLKECPPCAAPDAAGAPSVFIFPPKIKDVLMISLSPMVTCVVVDVSEDDPDVQISWFVNNVEVHTAQTQTHREDYNSTLRVVSALPIQHQDWMSGKAFACAVNNRALPSPIEKTISKPRGPVRAPQVYVLPPPAEEMTKKEFSLTCMIAGFLPAEIAVDWTSNGRTEQNYKNTATVLDSDGSYFMYSKLRVQKSTWERGSLFACSVVHEGLHNHLTTKTISRSLGK

SEQ ID NO: 299 - DNA, 858 bp, Artificial Sequence
  NHP CD86-AFH synthesized molecule
atgggactgagtaacattctctttgtgatggccttcctgctctctggtgctgctcccctgaagattcaggcttatttcaatgagactgcagacctgccatgccagtttgcaaactctcaaaaccgaagcctgagtgagctagtagtattttggcagaaccaggaaaacttggttctgaatgaggtatacttaggcaaagagaaatttgacagcgttcattccaagtatatgggccgcacaagttttgatccggagagttggaccctgaggcttcacaaccttcagatcaaggacaagggcttgtatcaatgtatcatccaccacaaaaggcccacaggaatgatccgcatccaccagatgaactctgaactgtcagtgcttgctaacttcagtcaacctgaaatagtcccaatttctaatataacagaaaatatgtacataaatttgacctgctcatctatacacggttacccagaacctgagaagatgagtgttttgctaagaaccaagaactcaactatcgagtatgatggtgttatgcagaaatctcaagataatgtcacagaactgtacgacgtttccatcagcttgtctgtttcattccctgatgttacgagcaacatgaccatcttctgtgttctggaaactgacaagacacagcttttatcctcacctttctctatagagcttgaggaccctcagcctcccccagactcctcgagcctgaacgacatcttcgaggctcagaaaatcgaatggcacgaagattacaaggatgacgacgataaggattacaaggatgacgacgataaggattacaaggatgacgacgataagcatcatcatcatcatcactga

SEQ ID NO: 300 - protein, 285 aa, Artificial Sequence
  NHP CD86-AFH synthesized molecule
NGLSNILFVMAFLLSGAAPLKIQAYFNETADLPCQFANSQNRSLSELVVFWQNQENLVLNEVYLGKEKFDSVHSKYMGRTSFDPESWTLRLHNLQIKDKGLYQCIIHHKRPTGMIRIHQMNSELSVLANFSQPEIVPISNITENMYINLTCSSIHGYPEPEKMSVLLRTKNSTIEYDGVMQKSQDNVTELYDVSISLSVSFPDVTSNMTIFCVLETDKTQLLSSPFSIELEDPQPPPDSSSLNDIFEAQKIEWHEDYKDDDDKDYKDDDDKDYKDDDDKHHHHHH

SEQ ID NO: 301 - DNA, 1629 bp, Artificial Sequence
  Nucleotide sequence encoding CTLA4::IL10 fusion protein with H69 linker
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtgagcagaagctgagcaacatggagaacagactgaagcccttcttcacaagcggctcagcagacacctccccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 302 - protein, 542 aa, Artificial Sequence
  CTLA4::IL10 fusion protein with H69 linker
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGEQKLSNMENRLKPFFTSGSADTSPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 303 - DNA, 1473 bp, Artificial Sequence
  FUN1 SMIP synthesized molecule
gaggtccaactgcagcagtctggacctgagctggagaagcctggcgcttcagtgaagatatcctgcaaggcttctggttactcattcactgactacaacatgaactgggtgaagcagagcaatggaaagagccttgagtggattggaaatattgatccttactatggtggtactagttacaatcagaagttcaagggcaaggccacattgactgtagacaaatcctccagcacagcctacatgcagctcaacagcctgacatctgaagactctgcagtctatttctgtgcaagatgggactataggtacgacgacgggagggcttactatgttatggacttctggggtcaaggaacctcagtcaccgtctcctcagggggtggaggctctggtggcggtggctctggcggaggtggatccggtggcggcggatctgagctccagatgacccagtctccatcatctctggctgcgtctgcaggagaaaaggtcactatgagctgtaagtccagtcaaagtgttttatacagttcaaatcagaagaactacttggcctggtaccagcagaaaccagggcagtctcctaaactgctgatctactgggcatccactagggaatctggtgtccctgatcgcttcacaggcagtggatctgggacacattttactctgaccgtcagcagtgtgcaagctgaagacctggcagtttattactgtcatcaatacctctactcgtggacgttcggtggaggcaccaacctggaaatcaaacggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 304 - protein, 490 aa, Artificial Sequence
  FUN1 SMIP synthesized molecule
EVQLQQSGPELEKPGASVKISCKASGYSFTDYNMNWVKQSNGKSLEWIGNIDPYYGGTSYNQKFKGKATLTVDKSSSTAYMQLNSLTSEDSAVYFCARWDYRYDDGRAYYVMDFWGQGTSVTVSSGGGGSGGGGSGGGGSGGGGSELQMTQSPSSLAASAGEKVTMSCKSSQSVLYSSNQKNYLAWYQQKPGQSPKLLIYWASTRESGVPDRFTGSGSGTHFTLTVSSVQAEDLAVYYCHQYLYSWTFGGGTNLEIKRLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 305 - protein, 125 aa, Artificial Sequence
  FUN1 heavy chain
EVQLQQSGPELEKPGASVKISCKASGYSFTDYNMNWVKQSNGKSLEWIGNIDPYYGGTSYNQKFKGKATLTVDKSSSTAYMQLNSLTSEDSAVYFCARWDYRYDDGRAYYVMDFWGQGTSVTVSS

SEQ ID NO: 306 - protein, 113 aa, Artificial Sequence
  FUN1 light chain
ELQMTQSPSSLAASAGEKVTMSCKSSQSVLYSSNQKNYLAWYQQKPGQSPKLLIYWASTRESGVPDRFTGSGSGTHFTLTVSSVQAEDLAVYYCHQYLYSWTFGGGTNLEIKR

SEQ ID NO: 307 - protein, 20 aa, Artificial Sequence
  FUN1 scFV linker
GGGGSGGGGSGGGGSGGGGS

SEQ ID NO: 308 - protein, 5 aa, Artificial Sequence
  FUN1 HCDR1
DYNMN

SEQ ID NO: 309 - protein, 16 aa, Artificial Sequence
  FUN1 HCDR2
IDPYYGGTSYNQKFKG

SEQ ID NO: 310 - protein, 16 aa, Artificial Sequence
  FUN1 HCDR3
WDYRYDDGRAYYVMDF

SEQ ID NO: 311 - protein, 17 aa, Artificial Sequence
  FUN1 LCDR1
KSSQSVLYSSNQKNYLA

SEQ ID NO: 312 - protein, 7 aa, Artificial Sequence
  FUN1 LCDR2
WASTRES

SEQ ID NO: 313 - protein, 8 aa, Artificial Sequence
  FUN1 LCDR3
HQYLYSWT

SEQ ID NO: 314 - DNA, 1530 bp, Artificial Sequence
  FUN1 PIMS synthesized molecule
gagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctgaggtccaactgcagcagtctggacctgagctggagaagcctggcgcttcagtgaagatatcctgcaaggcttctggttactcattcactgactacaacatgaactgggtgaagcagagcaatggaaagagccttgagtggattggaaatattgatccttactatggtggtactagttacaatcagaagttcaagggcaaggccacattgactgtagacaaatcctccagcacagcctacatgcagctcaacagcctgacatctgaagactctgcagtctatttctgtgcaagatgggactataggtacgacgacgggagggcttactatgttatggacttctggggtcaaggaacctcagtcaccgtctcctcagggggtggaggctctggtggcggtggctctggcggaggtggatccggtggcggcggatctgagctccagatgacccagtctccatcatctctggctgcgtctgcaggagaaaaggtcactatgagctgtaagtccagtcaaagtgttttatacagttcaaatcagaagaactacttggcctggtaccagcagaaaccagggcagtctcctaaactgctgatctactgggcatccactagggaatctggtgtccctgatcgcttcacaggcagtggatctgggacacattttactctgaccgtcagcagtgtgcaagctgaagacctggcagtttattactgtcatcaatacctctactcgtggacgttcggtggaggcaccaacctggaaatcaaacggtaa

SEQ ID NO: 315 - protein, 509 aa, Artificial Sequence
  FUN1 PIMS synthesized molecule
EPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSEVQLQQSGPELEKPGASVKISCKASGYSFTDYNMNWVKQSNGKSLEWIGNIDPYYGGTSYNQKFKGKATLTVDKSSSTAYMQLNSLTSEDSAVYFCARWDYRYDDGRAYYVMDFWGQGTSVTVSSGGGGSGGGGSGGGGSGGGGSELQMTQSPSSLAASAGEKVTMSCKSSQSVLYSSNQKNYLAWYQQKPGQSPKLLIYWASTRESGVPDRFTGSGSGTHFTLTVSSVQAEDLAVYYCHQYLYSWTFGGGTNLEIKR

SEQ ID NO: 316 - DNA, 1443 bp, Artificial Sequence
  3D1 SMIP synthesized molecule
caggtccagctgcagcagtctgggcctgagctggtgaggcctggggaatcagtgaagatttcctgcaagggttccggctacacattcactgattatgctatacagtgggtgaagcagagtcatgcaaagagtctagagtggattggagttattaatatttactatgataatacaaactacaaccagaagtttaagggcaaggccacaatgactgtagacaaatcctccagcacagcctatatggaacttgccagattgacatctgaggattctgccatctattactgtgcaagagcggcctggtatatggactactggggtcaaggaacctcagtcaccgtctcctcagggggtggaggctctggtggcggtggctctggcggaggtggatccggtggcggcggatctgacattgtgctgtcacagtctccatcctccctggctgtgtcagcaggagagaaggtcactatgagctgcaaatccagtcagagtctgctcaacagtagaacccgagagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcacgcaatcttataatctttacacgttcggaggggggaccaagctggaaataaaactcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 317 - protein, 480 aa, Artificial Sequence
  3D1 SMIP synthesized molecule
QVQLQQSGPELVRPGESVKISCKGSGYTFTDYAIQWVKQSHAKSLEWIGVINIYYDNTNYNQKFKGKATMTVDKSSSTAYMELARLTSEDSAIYYCARAAWYMDYWGQGTSVTVSSGGGGSGGGGSGGGGSGGGGSDIVLSQSPSSLAVSAGEKVTMSCKSSQSLLNSRTRENYLAWYQQKPGQSPKLLIYWASTRESGVPDRFTGSGSGTDFTLTISSVQAEDLAVYYCTQSYNLYTFGGGTKLEIKLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 318 - protein, 116 aa, Artificial Sequence
  3D1 heavy chain
QVQLQQSGPELVRPGESVKISCKGSGYTFTDYAIQWVKQSHAKSLEWIGVINIYYDNTNYNQKFKGKATMTVDKSSSTAYMELARLTSEDSAIYYCARAAWYMDYWGQGTSVTVSS

SEQ ID NO: 319 - protein, 112 aa, Artificial Sequence
  3D1 light chain
DIVLSQSPSSLAVSAGEKVTMSCKSSQSLLNSRTRENYLAWYQQKPGQSPKLLIYWASTRESGVPDRFTGSGSGTDFTLTISSVQAEDLAVYYCTQSYNLYTFGGGTKLEIK

SEQ ID NO: 320 - protein, 20 aa, Artificial Sequence
  3D1scFv linker
GGGGSGGGGSGGGGSGGGGS

SEQ ID NO: 321 - protein, 5 aa, Artificial Sequence
  3D1 HCDR1
DYAIQ

SEQ ID NO: 322 - protein, 17 aa, Artificial Sequence
  3D1 HCDR2
VINIYYDNTNYNQKFKG

SEQ ID NO: 323 - protein, 7 aa, Artificial Sequence
  3D1 HCDR3
AAWYMDY

SEQ ID NO: 324 - protein, 17 aa, Artificial Sequence
  3D1 LCDR1
KSSQSLLNSRTRENYLA

SEQ ID NO: 325 - protein, 7 aa, Artificial Sequence
  3D1 LCDR2
WASTRES

SEQ ID NO: 326 - protein, 8 aa, Artificial Sequence
  3D1 LCDR3
TQSYNLYT

SEQ ID NO: 327 - DNA, 1500 bp, Artificial Sequence
  3D1 PIMS synthesized molecule
gagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctcaggtccagctgcagcagtctgggcctgagctggtgaggcctggggaatcagtgaagatttcctgcaagggttccggctacacattcactgattatgctatacagtgggtgaagcagagtcatgcaaagagtctagagtggattggagttattaatatttactatgataatacaaactacaaccagaagtttaagggcaaggccacaatgactgtagacaaatcctccagcacagcctatatggaacttgccagattgacatctgaggattctgccatctattactgtgcaagagcggcctggtatatggactactggggtcaaggaacctcagtcaccgtctcctcagggggtggaggctctggtggcggtggctctggcggaggtggatccggtggcggcggatctgacattgtgctgtcacagtctccatcctccctggctgtgtcagcaggagagaaggtcactatgagctgcaaatccagtcagagtctgctcaacagtagaacccgagagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcacgcaatcttataatctttacacgttcggaggggggaccaagctggaaataaaataa

SEQ ID NO: 328 - protein, 499 aa, Artificial Sequence
  3D1 PIMS synthesized molecule
EPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSQVQLQQSGPELVRPGESVKISCKGSGYTFTDYAIQWVKQSHAKSLEWIGVINIYYDNTNYNQKFKGKATMTVDKSSSTAYMELARLTSEDSAIYYCARAAWYMDYWGQGTSVTVSSGGGGSGGGGSGGGGSGGGGSDIVLSQSPSSLAVSAGEKVTMSCKSSQSLLNSRTRENYLAWYQQKPGQSPKLLIYWASTRESGVPDRFTGSGSGTDFTLTISSVQAEDLAVYYCTQSYNLYTFGGGTKLEIK

SEQ ID NO: 329 - DNA, 2016 bp, Artificial Sequence
  Nucleotide sequence encoding M0115::IL10 I87A fusion protein with H75 linker
caggtgcagctggtgcagtctggggctgaggtgaagaagcctggggcctcagtgaaggtctcctgcaaggcttctggatacaccttcaccgactacaacatgaactgggtgcgacaggcccctggacaagggcttgagtggatgggaaatattgatccttactatggtggtactagttacaatcagaagttcaagggcagggtcaccatgaccagggacacgtccatcagcacagcctacatggagctgagcaggctgagatctgacgacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaggaactcagatggcaggtcattctccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 330 - protein, 671 aa, Artificial Sequence
  M0115::IL10 I87A fusion protein with H75 linker
QVQLVQSGAEVKKPGASVKVSCKASGYTFTDYNMNWVRQAPGQGLEWMGNIDPYYGGTSYNQKFKGRVTMTRDTSISTAYMELSRLRSDDTAVYYCARWDYRYDDGRAYYVMDFWGQGTTVTVSSGGGGSGGGGSGGGGSGGGGSDIVMTQSPDSLAVSLGERATINCKSSQSVLYSSNQKNYLAWYQQKPGQPPKLLIYWASTRESGVPDRFSGSGSGTDFTLTISSLQAEDVAVYYCHQYLYSWTFGQGTKLEIKRLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTGTQMAGHSPNSSPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYMTMKIRN

SEQ ID NO: 331 - DNA, 1500 bp, Artificial Sequence
  GL1 PIMS synthesized molecule
gagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctgaggtgcagctggtggagtctgctggaggtttagtgcagcctggaaggtccctaaaactctcctgtgcagcctcaggattcactttcagtgactattacatggcctgggtccgccaggctccaacgaaggggctggagtgggtcgcaaccattagtcatgacggtagtagtacttactatcgagactccgtgaagggccgattcacaatctccagagataatgcaaaaaccatcctatacctgcaaatggacagtctgaggtctgaggacacggccacttatttctgtgcaagacagaatattatggattattggggccaaggagtcatggtcacagtctcctcagggggtggaggctctggtggcggtggctctggcggaggtggatccggtggcggcggatctgacattgtgatgacccagactccatcctcccaggctgtgtcagcaggggagaaggtcactatgagctgcaagtccagtcagagtcttttgtacagtagagaccagagtaactacttggcctggtaccagcagaaacctgggcagtctcctaaactacttatctacttggcatccactagggaatcaggggtccctgatcgcttcataggcagtggctctgggacagacttcactctgaccatcagcagtgtgcaggctgaagatctggcagattattactgtcagcagcattacaactatccgctcacgttcggttctgggaccaagctagaaatcaaataa

SEQ ID NO: 332 - protein, 499 aa, Artificial Sequence
  GL1 PIMS synthesized molecule
EPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSEVQLVESAGGLVQPGRSLKLSCAASGFTFSDYYMAWVRQAPTKGLEWVATISHDGSSTYYRDSVKGRFTISRDNAKTILYLQMDSLRSEDTATYFCARQNIMDYWGQGVMVTVSSGGGGSGGGGSGGGGSGGGGSDIVMTQTPSSQAVSAGEKVTMSCKSSQSLLYSRDQSNYLAWYQQKPGQSPKLLIYLASTRESGVPDRFIGSGSGTDFTLTISSVQAEDLADYYCQQHYNYPLTFGSGTKLEIK

SEQ ID NO: 333 - DNA, 1986 bp, Artificial Sequence
  Nucleotide sequence encoding GL1::IL10 I87A fusion protein with H75 linker
gaggtgcagctggtggagtctgctggaggtttagtgcagcctggaaggtccctaaaactctcctgtgcagcctcaggattcactttcagtgactattacatggcctgggtccgccaggctccaacgaaggggctggagtgggtcgcaaccattagtcatgacggtagtagtacttactatcgagactccgtgaagggccgattcacaatctccagagataatgcaaaaaccatcctatacctgcaaatggacagtctgaggtctgaggacacggccacttatttctgtgcaagacagaatattatggattattggggccaaggagtcatggtcacagtctcctcagggggtggaggctctggtggcggtggctctggcggaggtggatccggtggcggcggatctgacattgtgatgacccagactccatcctcccaggctgtgtcagcaggggagaaggtcactatgagctgcaagtccagtcagagtcttttgtacagtagagaccagagtaactacttggcctggtaccagcagaaacctgggcagtctcctaaactacttatctacttggcatccactagggaatcaggggtccctgatcgcttcataggcagtggctctgggacagacttcactctgaccatcagcagtgtgcaggctgaagatctggcagattattactgtcagcagcattacaactatccgctcacgttcggttctgggaccaagctagaaatcaaactcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaggaactcagatggcaggtcattctccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 334 - protein, 661 aa, Artificial Sequence
  GL1::IL10 I87A fusion protein with H75 linker
EVQLVESAGGLVQPGRSLKLSCAASGFTFSDYYMAWVRQAPTKGLEWVATISHDGSSTYYRDSVKGRFTISRDNAKTILYLQMDSLRSEDTATYFCARQNIMDYWGQGVMVTVSSGGGGSGGGGSGGGGSGGGGSDIVMTQTPSSQAVSAGEKVTMSCKSSQSLLYSRDQSNYLAWYQQKPGQSPKLLIYLASTRESGVPDRFIGSGSGTDFTLTISSVQAEDLADYYCQQHYNYPLTFGSGTKLEIKLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTGTQMAGHSPNSSPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYMTMKIRN

SEQ ID NO: 335 - DNA, 1737 bp, Artificial Sequence
  Nucleotide sequence encoding CTLA4::PDL2 fusion protein with H65 linker
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgaccctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttaa

SEQ ID NO: 336 - protein, 578 aa, Artificial Sequence; identical to SEQ ID NO: 35
  CTLA4::PDL2 fusion protein with H65 linker

SEQ ID NO: 337 - DNA, 1551 bp, Artificial Sequence
  Nucleotide sequence encoding CTLA4::GITR fusion protein with H65 linker
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtcccccccggcagagccgcttgggtaa

SEQ ID NO: 338 - protein, 516 aa, Artificial Sequence; identical to SEQ ID NO: 42
  CTLA4::GITR fusion protein with H65 linker

SEQ ID NO: 339 - DNA, 1437 bp, Artificial Sequence
  Nucleotide sequence encoding CTLA4::TGFBetaR1 fusion protein with H65 linker
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaataa

SEQ ID NO: 340 - protein, 478 aa, Artificial Sequence
  CTLA4::TGFBetaR1 fusion protein with H65 linker
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVE

SEQ ID NO: 341 - DNA, 798 bp, Artificial Sequence
  Human CD86-AFH synthesized molecule
ctgaagattcaagcttatttcaataagactgcagacctgccatgccaatttgcaaactctcaaaaccaaagcctgagtgagctagtagtattttggcaggaccaggaaaacttggttctgaatgaggtatacttaggcaaagagaaatttgacagcgttcattccaagtatatgggccgcacaagttttgattcagacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtattatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagactctagactgaacgacatcttcgaggctcagaaaatcgaatggcacgaagattacaaggatgacgacgataaggattacaaggatgacgacgataaggattacaaggatgacgacgataagcatcatcatcatcatcactga

SEQ ID NO: 342 - protein, 265 aa, Artificial Sequence
  Human CD86-AFH synthesized molecule
LKIQAYFNKTADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDSRLNDIFEAQKIEWHEDYKDDDDKDYKDDDDKDYKDDDDKHHHHHH

SEQ ID NO: 343 - DNA, 801 bp, Artificial Sequence
  Mouse CD86-AFH synthesized molecule
gtggagacgcaagcttatttcaatgggactgcatatctgccgtgcccatttacaaaggctcaaaacataagcctgagtgagctggtagtattttggcaggaccagcaaaagttggttctgtacgagcactatttgggcacagagaaacttgatagtgtgaatgccaagtacctgggccgcacgagctttgacaggaacaactggactctacgacttcacaatgttcagatcaaggacatgggctcgtatgattgttttatacaaaaaaagccacccacaggatcaattatcctccaacagacattaacagaactgtcagtgatcgccaacttcagtgaacctgaaataaaactggctcagaatgtaacaggaaattctggcataaatttgacctgcacgtctaagcaaggtcacccgaaacctaagaagatgtattttctgataactaattcaactaatgagtatggtgataacatgcagatatcacaagataatgtcacagaactgttcagtatctccaacagcctctctctttcattcccggatggtgtgtggcatatgaccgttgtgtgtgttctggaaacggagtcaatgaagatttcctccaaacctctcaatttcactcaagagtttccatctcctcaaacgtattggaaggagtctagactgaacgacatcttcgaggctcagaaaatcgaatggcacgaagattacaaggatgacgacgataaggattacaaggatgacgacgataaggattacaaggatgacgacgataagcatcatcatcatcatcactga

SEQ ID NO: 344 - protein, 266 aa, Artificial Sequence
  Mouse CD86-AFH synthesized molecule
VETQAYFNGTAYLPCPFTKAQNISLSELVVFWQDQQKLVLYEHYLGTEKLDSVNAKYLGRTSFDRNNWTLRLHNVQIKDMGSYDCFIQKKPPTGSIILQQTLTELSVIANFSEPEIKLAQNVTGNSGINLTCTSKQGHPKPKKMYFLITNSTNEYGDNMQISQDNVTELFSISNSLSLSFPDGVWHMTVVCVLETESMKISSKPLNFTQEFPSPQTYWKESRLNDIFEAQKIEWHEDYKDDDDKDYKDDDDKDYKDDDDKHHHHHH

SEQ ID NO: 345 - DNA, 1116 bp, Artificial Sequence
  GITR Ig synthesized molecule
cagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggttaa

SEQ ID NO: 346 - protein, 371 aa, Artificial Sequence
  GITR Ig synthesized molecule
QRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 347 - DNA, 1137 bp, Artificial Sequence
  PD1 Ig synthesized molecule
ttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaactcgagcagcccagagggcccacaatcaagccctgtcctccatgcaaatgcccggctccaaatcttcttggtggttcatccgtcttcatcttccctccaaagatcaaggatgtactcatgatctccctgagccccatagtcacatgtgtggtggtggatgtgagcgaggacgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggactaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaataa

SEQ ID NO: 348 - protein, 378 aa, Artificial Sequence
  PD1 Ig synthesized molecule
LDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQLEQPRGPTIKPCPPCKCPAPNLLGGSSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 349 - DNA, 1995 bp, Artificial Sequence
  Nucleotide sequence encoding IL10 I87A::M0115 fusion protein with H81 linker
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtgaagttcaaattcccttgaccgaaagttacagcccgaattctcaggtgcagctggtgcagtctggggctgaggtgaagaagcctggggcctcagtgaaggtctcctgcaaggcttctggatacaccttcaccgactacaacatgaactgggtgcgacaggcccctggacaagggcttgagtggatgggaaatattgatccttactatggtggtactagttacaatcagaagttcaagggcagggtcaccatgaccagggacacgtccatcagcacagcctacatggagctgagcaggctgagatctgacgacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggtaa

SEQ ID NO: 350 - protein, 664 aa, Artificial Sequence
  IL10 I87A::M0115 fusion protein with H81 linker
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGEVQIPLTESYSPNSQVQLVQSGAEVKKPGASVKVSCKASGYTFTDYNMNWVRQAPGQGLEWMGNIDPYYGGTSYNQKFKGRVTMTRDTSISTAYMELSRLRSDDTAVYYCARWDYRYDDGRAYYVMDFWGQGTTVTVSSGGGGSGGGGSGGGGSGGGGSDIVMTQSPDSLAVSLGERATINCKSSQSVLYSSNQKNYLAWYQQKPGQPPKLLIYWASTRESGVPDRFSGSGSGTDFTLTISSLQAEDVAVYYCHQYLYSWTFGQGTKLEIKR

SEQ ID NO: 351 - DNA, 1986 bp, Artificial Sequence
  Nucleotide sequence encoding IL10 I87A::M0115 fusion protein with H82 linker
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcacgacggctcttccctgaatacaccgaattctcaggtgcagctggtgcagtctggggctgaggtgaagaagcctggggcctcagtgaaggtctcctgcaaggcttctggatacaccttcaccgactacaacatgaactgggtgcgacaggcccctggacaagggcttgagtggatgggaaatattgatccttactatggtggtactagttacaatcagaagttcaagggcagggtcaccatgaccagggacacgtccatcagcacagcctacatggagctgagcaggctgagatctgacgacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggtaa

SEQ ID NO: 352 - protein, 661 aa, Artificial Sequence
  IL10 I87A::M0115 fusion protein with H82 linker
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGHDGSSLNTPNSQVQLVQSGAEVKKPGASVKVSCKASGYTFTDYNMNWVRQAPGQGLEWMGNIDPYYGGTSYNQKFKGRVTMTRDTSISTAYMELSRLRSDDTAVYYCARWDYRYDDGRAYYVMDFWGQGTTVTVSSGGGGSGGGGSGGGGSGGGGSDIVMTQSPDSLAVSLGERATINCKSSQSVLYSSNQKNYLAWYQQKPGQPPKLLIYWASTRESGVPDRFSGSGSGTDFTLTISSLQAEDVAVYYCHQYLYSWTFGQGTKLEIKR

SEQ ID NO: 353 - DNA, 2001 bp, Artificial Sequence
  Nucleotide sequence encoding IL10 I87A::M0115 fusion protein with H83 linker
agcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacgccaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacattacaatgaagatacgaaacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggttcttccctgaatacaggaactcagatggcaggtcattctccgaattctcaggtgcagctggtgcagtctggggctgaggtgaagaagcctggggcctcagtgaaggtctcctgcaaggcttctggatacaccttcaccgactacaacatgaactgggtgcgacaggcccctggacaagggcttgagtggatgggaaatattgatccttactatggtggtactagttacaatcagaagttcaagggcagggtcaccatgaccagggacacgtccatcagcacagcctacatggagctgagcaggctgagatctgacgacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggtaa

SEQ ID NO: 354 - protein, 666 aa, Artificial Sequence
  IL10 I87A::M0115 fusion protein with H83 linker
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYITMKIRNLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGSSLNTGTQMAGHSPNSQVQLVQSGAEVKKPGASVKVSCKASGYTFTDYNMNWVRQAPGQGLEWMGNIDPYYGGTSYNQKFKGRVTMTRDTSISTAYMELSRLRSDDTAVYYCARWDYRYDDGRAYYVMDFWGQGTTVTVSSGGGGSGGGGSGGGGSGGGGSDIVMTQSPDSLAVSLGERATINCKSSQSVLYSSNQKNYLAWYQQKPGQPPKLLIYWASTRESGVPDRFSGSGSGTDFTLTISSLQAEDVAVYYCHQYLYSWTFGQGTKLEIKR

SEQ ID NO: 355 - protein, 20 aa, Artificial Sequence
  H68 Linker
NSLFNQEVQIPLTESYSPNS

SEQ ID NO: 356 - protein, 26 aa, Artificial Sequence
  H69 Linker
EQKLSNMENRLKPFFTSGSADTSPNS

SEQ ID NO: 357 - protein, 17 aa, Artificial Sequence
  H77 Linker
NSLFNQEVQIPLTEPNS

SEQ ID NO: 358 - protein, 14 aa, Artificial Sequence
  H78 Linker
NSLFNQEVQIPPNS

SEQ ID NO: 359 - protein, 11 aa, Artificial Sequence
  H79 Linker
NSLFNQEVPNS

SEQ ID NO: 360 - protein, 13 aa, Artificial Sequence
  H80 Linker
QRHNNSSLNTPNS

SEQ ID NO: 361 - protein, 14 aa, Artificial Sequence
  H81 Linker
EVQIPLTESYSPNS

SEQ ID NO: 362 - protein, 11 aa, Artificial Sequence
  H82 Linker
HDGSSLNTPNS

SEQ ID NO: 363 - protein, 16 aa, Artificial Sequence
  H83 Linker
SSLNTGTQMAGHSPNS

SEQ ID NO: 364 - protein, 9 aa, Artificial Sequence
  A2 Hinge
PPPPPCPPC

SEQ ID NO: 365 - protein, 21 aa, Artificial Sequence
  H75 Linker
QRHNNSSLNTGTQMAGHSPNS

SEQ ID NO: 366 - protein, 21 aa, Artificial Sequence
  H75aLinker
QRHNNSSLNTGTQKARHSPNS

SEQ ID NO: 367 - protein, 21 aa, Artificial Sequence
  H75b Linker
QRHNNSSLNTGTQMARHSPNS

SEQ ID NO: 368 - protein, 21 aa, Artificial Sequence
  H75c Linker
QRHNNSSLNTRTQKAGHSPNS

SEQ ID NO: 369 - protein, 21 aa, Artificial Sequence
  H75d Linker
QRHNNSSLNTRTQMAGHSPNS

SEQ ID NO: 370 - protein, 21 aa, Artificial Sequence
  H75e Linker
QRHNNSSLNTRTQMARHSPNS

SEQ ID NO: 371 - protein, 21 aa, Artificial Sequence
  H75f Linker
QRHANSALNTGTQMAGHSPNS

SEQ ID NO: 372 - protein, 21 aa, Artificial Sequence
  H75g Linker
QRHNAASLNTGTQMAGHSPNS

SEQ ID NO: 373 - protein, 21 aa, Artificial Sequence
  H75h Linker
QRHAASSLNTGTQMAGHSPNS

SEQ ID NO: 374 - protein, 20 aa, Artificial Sequence
  H68a Linker
NSLANQEVQIPLTESYSPNS

SEQ ID NO: 375 - protein, 20 aa, Artificial Sequence
  H68b Linker
NSGFNQEVQIPLTESYSPNS

SEQ ID NO: 376 - protein, 20 aa, Artificial Sequence
  H68c Linker
NSGANQEVQIPLTESYSPNS

SEQ ID NO: 377 - protein, 16 aa, Artificial Sequence
  H68s Linker
NQEVQIPLTESYSPNS

SEQ ID NO: 378 - protein, 5 aa, Artificial Sequence
  Variable Region Linker Subunit
GGGGS

SEQ ID NO: 379 - protein, 6 aa, Artificial Sequence
  monoIL10 Linker
GGGSGG

SEQ ID NO: 380 - protein, 166 aa, Artificial Sequence
  monoIL10 synthesized molecule
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 381 - protein, 160 aa, Artificial Sequence
  IL10 I87A synthesized molecule
SPGQGTQSENSCTHFPGNLPNMLRDLRDAFSRVKTFFQMKDQLDNLLLKESLLEDFKGYLGCQALSEMIQFYLEEVMPQAENQDPDAKAHVNSLGENLKTLRLRLRRCHRFLPCENKSKAVEQVKNAFNKLQEKGIYKAMSEFDIFINYIEAYMTMKIRN

SEQ ID NO: 382 - protein, 160 aa, Artificial Sequence
  IL10 I87S synthesized molecule
SPGQGTQSENSCTHFPGNLPNMLRDLRDAFSRVKTFFQMKDQLDNLLLKESLLEDFKGYLGCQALSEMIQFYLEEVMPQAENQDPDSKAHVNSLGENLKTLRLRLRRCHRFLPCENKSKAVEQVKNAFNKLQEKGIYKAMSEFDIFINYIEAYMTMKIRN

SEQ ID NO: 383 - protein, 10 aa, Homo sapiens
EPKSCDKTHT

SEQ ID NO: 384 - protein, 7 aa, Homo sapiens
ERKCCVE

SEQ ID NO: 385 - protein, 12 aa, Homo sapiens
ELKTPLGDTTHT

SEQ ID NO: 386 - protein, 10 aa, Homo sapiens
EPKSCDTPPP

SEQ ID NO: 387 - protein, 7 aa, Homo sapiens
ESKYGPP

SEQ ID NO: 388 - protein, 5 aa, Homo sapiens
CPRCP

SEQ ID NO: 389 - protein, 5 aa, Homo sapiens
CPSCP

SEQ ID NO: 390 - protein, 17 aa, Homo sapiens
ELKTPLGDTTHTCPRCP

SEQ ID NO: 391 - protein, 15 aa, Homo sapiens
EPKSCDTPPPCPRCP

SEQ ID NO: 392 - protein, 34 aa, Homo sapiens
ESPKAQASSVPTAQPQAEGSLAKATTAPATTRNT

SEQ ID NO: 393 - protein, 24 aa, Homo sapiens
GRGGEEKKKEKEKEEQEERETKTP

SEQ ID NO: 394 - protein, 19 aa, Homo sapiens
VPSTPPTPSPSTPPTPSPS

SEQ ID NO: 395 - protein, 6 aa, Homo sapiens
VPPPPP

SEQ ID NO: 396 - protein, 107 aa, Homo sapiens
VCSRDFTPPTVKILQSSSDGGGHFPPTIQLLCLVSGYTPGTINITWLEDGQVMDVDLSTASTTQEGELASTQSELTLSQKHWLSDRTYTCQVTYQGHTFEDSTKKCA

SEQ ID NO: 397 - protein, 112 aa, Homo sapiens
VIAELPPKVSVFVPPRDGFFGNPRKSKLICQATGFSPRQIQVSWLREGKQVGSGVTTDQVQAEAKESGPTTYKVTSTLTIKESDWLGQSMFTCRVDHRGLTFQQNASSMCVP

SEQ ID NO: 398 - protein, 5 aa, Homo sapiens
CPPCP

SEQ ID NO: 399 - DNA, 1614 bp, Artificial Sequence
  Nucleotide sequence encoding CTLA4 x IL10 IgA fusion protein
atgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacctcgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtccctcaactccacctaccccatctccctcaactccacctaccccatctccctcaccgaattctagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactaa

SEQ ID NO: 400 - protein, 537 aa, Artificial Sequence
  CTLA4 x IL10 IgA fusion protein
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDLEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGPSTPPTPSPSTPPTPSPSPNSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 401 - DNA, 1530 bp, Artificial Sequence
  M0115 PIMS synthesized molecule
gagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaactcattattcaaccaagaagttcaaattcccttgaccgaaagttacagcccgaattctcaggtgcagctggtgcagtctggggctgaggtgaagaagcctggggcctcagtgaaggtctcctgcaaggcttctggatacaccttcaccgactacaacatgaactgggtgcgacaggcccctggacaagggcttgagtggatgggaaatattgatccttactatggtggtactagttacaatcagaagttcaagggcagggtcaccatgaccagggacacgtccatcagcacagcctacatggagctgagcaggctgagatctgacgacacggccgtgtattactgtgcgagatgggactataggtacgacgacgggagggcttactatgttatggacttctggggccaagggaccacggtcaccgtctcctcaggtggaggcggttcaggcggaggtggatccggcggtggcggatcgggtggcggcggatctgacatcgtgatgacccagtctccagactccctggctgtgtctctgggcgagagggccaccatcaactgcaagtccagccagagtgttttatacagctccaaccagaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcatcaatacctctactcgtggacgtttggccaggggaccaagctggagatcaaacggtaa

SEQ ID NO: 402 - protein, 509 aa, Artificial Sequence
  M0115 PIMS synthesized molecule
EPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGNSLFNQEVQIPLTESYSPNSQVQLVQSGAEVKKPGASVKVSCKASGYTFTDYNMNWVRQAPGQGLEWMGNIDPYYGGTSYNQKFKGRVTMTRDTSISTAYMELSRLRSDDTAVYYCARWDYRYDDGRAYYVMDFWGQGTTVTVSSGGGGSGGGGSGGGGSGGGGSDIVMTQSPDSLAVSLGERATINCKSSQSVLYSSNQKNYLAWYQQKPGQPPKLLIYWASTRESGVPDRFSGSGSGTDFTLTISSLQAEDVAVYYCHQYLYSWTFGQGTKLEIKR

SEQ ID NO: 403 - DNA, 1095 bp, Artificial Sequence; identical to SEQ ID NO: 297
  Nucleotide sequence encoding murine CTLA4 fusion to human Fc domains

SEQ ID NO: 404 - protein, 364 aa, Artificial Sequence; identical to SEQ ID NO: 298
  Murine CTLA4 fusion to human Fc domains

SEQ ID NO: 405 - DNA, 570 bp, Artificial Sequence
  Nucleotide sequence encoding PD1 ectodomain fused to a C-terminal AviTag
ttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaatctagactgaacgacatcttcgaggctcagaaaatcgaatggcacgaagattacaaggatgacgacgataaggattacaaggatgacgacgataaggattacaaggatgacgacgataagcatcatcatcatcatcactga

SEQ ID NO: 406 - protein, 189 aa, Artificial Sequence
  PD1 ectodomain fused to a C-terminal AviTag
LDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQSRLNDIFEAQKIEWHEDYKDDDDKDYKDDDDKDYKDDDDKHHHHHH

SEQ ID NO: 407 - protein, 19 aa, Artificial Sequence
  H75i Linker
QRHSSLNTGTQMAGHSPNS

SEQ ID NO: 408 - protein, 21 aa, Artificial Sequence
  H75j Linker
QRHGGSSLNTGTQMAGHSPNS

SEQ ID NO: 409 - protein, 217 aa, Artificial Sequence
  human IgG1 CH2 and CH3 regions
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 410 - protein, 124 aa, Homo sapiens [sequence omitted]

SEQ ID NO: 411 - protein, 124 aa, Artificial Sequence
  CTLA4 with  A29Y L104E mutatations
MHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSD

SEQ ID NO: 412 - protein, 134 aa, Homo sapiens
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 413 - DNA, 1530 bp, Artificial Sequence; identical to SEQ ID NO: 401
  FUN1 PIMS M0115 synthesized molecule

SEQ ID NO: 414 - protein, 509 aa, Artificial Sequence; identical to SEQ ID NO: 402
  FUN1 PIMS M0115 synthesized molecule

SEQ ID NO: 415 - protein, 216 aa, Artificial Sequence
  Human IgG1 CH2CH3 desLys
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 416 - protein, 217 aa, Artificial Sequence
  Human IgG1 CH2CH3 Null2
APEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 417 - protein, 216 aa, Artificial Sequence
  Human IgG1 CH2CH3 Null2 desLys
APEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 418 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 419 - protein, 23 aa, Artificial Sequence
  Heterologous leader sequence
  VARIANT (23)..(23): Xaa = Any Amino Acid
MDFQVQIFSFLLISASVIMSRGX

SEQ ID NO: 420 - protein, 24 aa, Artificial Sequence
  Heterologous leader sequence
  VARIANT (23)..(24): Xaa = Any Amino Acid
MDFQVQIFSFLLISASVIMSRGXX

SEQ ID NO: 421 - protein, 25 aa, Artificial Sequence
  Heterologous leader sequence
  VARIANT (23)..(25): Xaa = Any Amino Acid
MDFQVQIFSFLLISASVIMSRGXXX

SEQ ID NO: 422 - protein, 4 aa, Unknown
  A naturally occurring or added motif that confers the capacity to form a disulfide bond
CPPC

What is claimed is:

1. A multi-specific fusion protein, comprising a CD86 binding domain linked to a heterologous binding domain by an intervening domain, wherein the heterologous binding domain is an IL-10 or a monoIL10 that is an IL-10 molecule having a short linker that separates two subdomains of the IL-10 molecule, and wherein the CD86 binding domain comprises heavy chain and light chain variable regions of a CD86-specific antibody binding domain.

2. The multi-specific fusion protein of claim 1, wherein the CD86 binding domain is a Fab or a scFv specific for CD86.

3. The multi-specific fusion protein of claim 2, wherein the CD86 binding domain of the Fab or scFv comprises light and heavy chain variable domains of SEQ ID NOs: 305 and 306 or humanized variants thereof.

4. The multi-specific fusion protein of claim 1, wherein the CD86 binding domain comprises amino acids 1-258 of SEQ ID NO:187 or 237.

5. The multi-specific fusion protein of claim 1, wherein the IL-10 comprises the amino acid sequence of SEQ ID NO:7, SEQ ID NO: 7 comprising a point mutation at position 87 or SEQ ID NO:418.

6. The multi-specific fusion protein of claim 1, wherein the intervening domain comprises an immunoglobulin constant region or constant sub-region disposed between the CD86 binding domain and the heterologous binding domain.

7. The multi-specific fusion protein of claim 6, wherein the immunoglobulin constant region comprises IgG1 CH2 and CH3 domains.

8. The multi-specific fusion protein of claim 1, wherein the intervening domain comprises an immunoglobulin constant region disposed between a first and a second linker, wherein the first and second linkers are independently selected from the group consisting of SEQ ID NOs:43-166, 244, 307, 320, 355-379 and 383-398.

9. The multi-specific fusion protein of claim 1, wherein the intervening domain comprises a human immunoglobulin Fc region, albumin, transferrin, or a scaffold domain that binds a serum protein or a combination thereof.

10. The multi-specific fusion protein of claim 1, wherein the intervening domain comprises a structure, from amino-terminus to carboxy-terminus, as follows:

-L1-X-L2- wherein:
L1 and L2 are each independently a linker comprising from about two to about 150 amino acids; and
X is selected from the group consisting of: an immunoglobulin constant region, an immunoglobulin constant sub-region, albumin, transferrin and a serum protein binding protein.

11. The multi-specific fusion protein of claim 10, wherein the immunoglobulin constant region or constant sub-region comprises IgG1 CH2 and CH3 domains.

12. The multi-specific fusion protein of claim 10, wherein L1 is a human immunoglobulin hinge region.

13. The multi-specific fusion protein of claim 10, wherein X is a human IgG1 Fc domain or at least one CH domain thereof.

14. The multi-specific fusion protein of claim 1, wherein the intervening domain comprises a dimerization domain.

15. The multi-specific fusion protein of claim 1, wherein the fusion protein comprises an amino acid sequence selected from the group consisting of: SEQ ID NOs: 183, 185, 187, 189, 211, 213, 215, 237, 239, 252, 254, 256, 258, 260, 276, 302, 330, 334, 350, 352, and 354.

16. A composition comprising the multi-specific fusion protein of claim 1 and a pharmaceutically acceptable carrier, diluent, or excipient.

17. An isolated polynucleotide encoding the multi-specific fusion protein of claim 1.

18. The polynucleotide of claim 17, wherein the polynucleotide comprises a nucleic acid sequence selected from the group consisting of: SEQ ID NOs: 182, 184, 186, 188, 210, 212, 214, 236, 238, 251, 253, 255, 257, 259, 275, 301, 329, 333, 349, 351, and 353.

19. An isolated expression vector comprising the polynucleotide according to claim 17 operably linked to an expression control sequence.

20. An isolated host cell comprising the expression vector according to claim 19.

21. A method for treating a subject with a disorder associated with CD86, IL-10, or a combination thereof, comprising administering a therapeutically effective amount of the multi-specific fusion protein of claim 1.

22. A method of treating a subject with an autoimmune disease, or suppressing a detrimental alloresponse to an organ transplant, wherein the autoimmune disease is selected from the group consisting of: rheumatoid arthritis, juvenile rheumatoid arthritis, asthma, systemic lupus erythematosus (SLE), inflammatory bowel disease (including Crohn's disease and ulcerative colitis), graft versus host disease, psoriasis, multiple sclerosis, dermatomyositis, polymyositis, pernicious anaemia, primary biliary cirrhosis, acute disseminated encephalomyelitis (ADEM), Addison's disease, ankylosing spondylitis, antiphospholipid antibody syndrome (APS) autoimmune hepatitis, diabetes mellitus type 1, Goodpasture's syndrome, Graves' disease, Guillain-Barré syndrome (GBS), Hashimoto's disease, idiopathic thrombocytopenic purpura, lupus erythematosus, pemphigus vulgaris, Sjögren's syndrome, temporal arthritis (also known as "giant cell arthritis"), autoimmune hemolytic anemia, bullous pemphigoid, vasculitis, coeliac disease, endometriosis, hidradenitis suppurativa, interstitial cystitis, morphea, scleroderma, narcolepsy, neuromyotonia, vitiligo, and autoimmune inner ear disease, comprising administering to the subject a therapeutically effective amount of the multi-specific fusion protein of claim 1.

23. The multi-specific fusion protein of claim 1, wherein the CD86 binding domain comprises a heavy chain variable region and a light chain variable region, wherein the heavy chain comprises a CDR1 of SEQ ID NO:308, a CDR2 of SEQ ID NO:309, and a CDR3 of SEQ ID NO:310, and wherein the light chain comprises a CDR1 of SEQ ID NO:311, a CDR2 of SEQ ID NO:312, and a CDR3 of SEQ ID NO:313.

24. The multi-specific fusion protein of claim 1, wherein the monoIL10 comprises SEQ ID NO:380.

25. The multi-specific fusion protein of claim 1, wherein the IL-10 or monoIL10 comprises an amino acid sequence selected from the group consisting of SEQ ID NOs:380-382.

26. The multi-specific fusion protein of claim 1, wherein the intervening domain comprises an amino acid sequence selected from the group consisting of SEQ ID NOS:409 and 415-417.

27. The multi-specific fusion protein of claim 8, wherein the first linker is selected from the group consisting of SEQ ID NOS:89, 100, and 159-164.

28. The multi-specific fusion protein of claim 12, wherein zero, one, or more cysteine residues in the human immunoglobulin hinge region is each substituted with another amino acid.

29. A multi-specific fusion protein, comprising a CD86 binding domain having amino acids 1-258 of SEQ ID NO:187 linked to a heterologous binding domain by an intervening domain, wherein the heterologous binding domain is an IL-10 or a monoIL10 that is an IL-10 molecule having a short linker that separates two subdomains of the IL-10 molecule, and wherein the IL-10 or the monoIL10 comprises SEQ ID NO:418 or 380.

30. A multi-specific fusion protein, comprising a CD86 binding domain linked to a heterologous binding domain by an intervening domain, wherein the heterologous binding domain is an IL-10 or a monoIL10 that is an IL-10 molecule having a short linker that separates two subdomains of the IL-10 molecule, and wherein the CD86 binding domain comprises heavy chain and light chain variable regions of a CD86-specific antibody binding domain; and wherein the CD86 binding domain comprises:
  (a) an HCDR1 of SEQ ID NO:308, an HCDR2 of SEQ ID NO:309, an HCDR3 of SEQ ID NO:310, an LCDR1 of SEQ ID NO:311, an LCDR2 of SEQ ID NO:312, and an LCDR3 of SEQ ID NO:313; or
  (b) an HCDR1 of SEQ ID NO:321, an HCDR2 of SEQ ID NO:322, an HCDR3 of SEQ ID NO:323, an LCDR1 of SEQ ID NO:324, an LCDR2 of SEQ ID NO:325, and an LCDR3 of SEQ ID NO:326.

31. The multi-specific fusion protein of claim 30, wherein the IL-10 or the monoIL10 comprises SEQ ID NO:418 or 380.

32. The multi-specific fusion protein of claim 31, wherein the intervening domain comprises a linker comprising SEQ ID NO:89 and a human immunoglobulin Fc region comprising SEQ ID NO:417.

33. The multi-specific fusion protein of claim 32, wherein the intervening domain further comprises an additional linker derived from a stalk region of a type II C-type lectin protein selected from the group consisting of CD69, CD72, CD94, NKG2A, and NKG2D.

* * * * *